(12) United States Patent
Liu et al.

(10) Patent No.: US 12,157,760 B2
(45) Date of Patent: Dec. 3, 2024

(54) BASE EDITORS AND USES THEREOF

(71) Applicants: The Broad Institute, Inc., Cambridge, MA (US); President and Fellows of Harvard College, Cambridge, MA (US)

(72) Inventors: David R. Liu, Cambridge, MA (US); Luke W. Koblan, Cambridge, MA (US); Christopher Gerard Wilson, Cambridge, MA (US); Jordan Leigh Doman, Cambridge, MA (US)

(73) Assignees: The Broad Institute, Inc., Cambridge, MA (US); President and Fellows of Harvard College, Cambridge, MA (US)

( * ) Notice: Subject to any disclaimer, the term of this patent is extended or adjusted under 35 U.S.C. 154(b) by 1002 days.

(21) Appl. No.: 17/057,398

(22) PCT Filed: May 23, 2019

(86) PCT No.: PCT/US2019/033848
§ 371 (c)(1),
(2) Date: Nov. 20, 2020

(87) PCT Pub. No.: WO2019/226953
PCT Pub. Date: Nov. 28, 2019

(65) Prior Publication Data
US 2021/0198330 A1 Jul. 1, 2021

Related U.S. Application Data

(60) Provisional application No. 62/677,658, filed on May 29, 2018, provisional application No. 62/675,726, filed on May 23, 2018.

(51) Int. Cl.
C07K 14/47 (2006.01)
C12N 9/22 (2006.01)
C12N 9/78 (2006.01)

(52) U.S. Cl.
CPC ............ *C07K 14/4702* (2013.01); *C12N 9/22* (2013.01); *C12N 9/78* (2013.01); *C07K 2319/09* (2013.01); *C12Y 305/04004* (2013.01); *C12Y 305/04005* (2013.01)

(58) Field of Classification Search
CPC .. C07K 14/4702; C07K 2319/09; C12N 9/22; C12N 9/78; C12Y 305/04004; C12Y 305/04005; A61K 31/713
See application file for complete search history.

(56) References Cited

U.S. PATENT DOCUMENTS

| | | | |
|---|---|---|---|
| 4,182,449 A | 1/1980 | Kozlow | |
| 4,186,183 A | 1/1980 | Steck et al. | |
| 4,217,344 A | 8/1980 | Vanlerberghe et al. | |
| 4,235,871 A | 11/1980 | Papahadjopoulos et al. | |
| 4,261,975 A | 4/1981 | Fullerton et al. | |
| 4,485,054 A | 11/1984 | Mezei et al. | |
| 4,501,728 A | 2/1985 | Geho et al. | |
| 4,663,290 A | 5/1987 | Weis et al. | |
| 4,737,323 A | 4/1988 | Martin et al. | |
| 4,774,085 A | 9/1988 | Fidler | |
| 4,797,368 A | 1/1989 | Carter et al. | |
| 4,837,028 A | 6/1989 | Allen | |
| 4,873,316 A | 10/1989 | Meade et al. | |
| 4,880,635 A | 11/1989 | Janoff et al. | |
| 4,889,818 A | 12/1989 | Gelfand et al. | |
| 4,897,355 A | 1/1990 | Eppstein et al. | |
| 4,906,477 A | 3/1990 | Kurono et al. | |
| 4,911,928 A | 3/1990 | Wallach | |
| 4,917,951 A | 4/1990 | Wallach | |

(Continued)

FOREIGN PATENT DOCUMENTS

AU 2012244264 A1 11/2012
AU 2012354062 A1 7/2014
(Continued)

OTHER PUBLICATIONS

U.S. Appl. No. 61/874,746, filed Sep. 6, 2013, Liu et al.
U.S. Appl. No. 61/874,682, filed Sep. 6, 2013, Liu et al.
U.S. Appl. No. 61/838,178, filed Jun. 21, 2013, Joung et al.
U.S. Appl. No. 61/837,481, filed Jun. 20, 2013, Cho et al.
U.S. Appl. No. 61/803,599, filed Mar. 20, 2013, Kim et al.
U.S. Appl. No. 61/794,422, filed Mar. 15, 2013, Knight et al.
U.S. Appl. No. 61/761,046, filed Feb. 5, 2013, Knight et al.
U.S. Appl. No. 61/758,624, filed Jan. 30, 2013, Chen et al.
U.S. Appl. No. 61/734,256, filed Dec. 6, 2012, Chen et al.
U.S. Appl. No. 61/717,324, filed Oct. 23, 2012, Cho et al.
U.S. Appl. No. 61/716,256, filed Oct. 19, 2012, Jinek et al.
(Continued)

*Primary Examiner* — Brian Whiteman
*Assistant Examiner* — Stephanie L Sullivan
(74) *Attorney, Agent, or Firm* — Wolf, Greenfield & Sacks, P.C.

(57) ABSTRACT

Some aspects of this disclosure provide strategies, systems, reagents, methods, and kits that are useful for the targeted editing of nucleic acids, including editing a single site within the genome of a cell or subject, e.g., within the human genome. The disclosure provides fusion proteins of nucleic acid programmable DNA binding proteins (napDNAbp), e.g., Cas9 or variants thereof, and nucleic acid editing proteins such as cytidine deaminase domains (e.g., novel cytidine deaminases generated by ancestral sequence reconstruction), and adenosine deaminases that deaminate adenine in DNA. Aspects of the disclosure relate to fusion proteins (e.g., base editors) that have improved expression and/or localize efficiently to the nucleus. In some embodiments, base editors are codon optimized for expression in mammalian cells. In some embodiments, base editors include multiple nuclear localization sequences (e.g., bipartite NLSs), e.g., at least two NLSs. In some embodiments, methods for targeted nucleic acid editing are provided.

18 Claims, 48 Drawing Sheets

Specification includes a Sequence Listing.

(56) References Cited

U.S. PATENT DOCUMENTS

| | | |
|---|---|---|
| 4,920,016 A | 4/1990 | Allen et al. |
| 4,921,757 A | 5/1990 | Wheatley et al. |
| 4,946,787 A | 8/1990 | Eppstein et al. |
| 4,965,185 A | 10/1990 | Grischenko et al. |
| 5,017,492 A | 5/1991 | Kotewicz et al. |
| 5,047,342 A | 9/1991 | Chatterjee |
| 5,049,386 A | 9/1991 | Eppstein et al. |
| 5,079,352 A | 1/1992 | Gelfand et al. |
| 5,139,941 A | 8/1992 | Muzyczka et al. |
| 5,173,414 A | 12/1992 | Lebkowski et al. |
| 5,223,409 A | 6/1993 | Ladner et al. |
| 5,244,797 A | 9/1993 | Kotewicz et al. |
| 5,270,179 A | 12/1993 | Chatterjee |
| 5,374,553 A | 12/1994 | Gelfand et al. |
| 5,405,776 A | 4/1995 | Kotewicz et al. |
| 5,436,149 A | 7/1995 | Barnes |
| 5,449,639 A | 9/1995 | Wei et al. |
| 5,496,714 A | 3/1996 | Comb et al. |
| 5,512,462 A | 4/1996 | Cheng |
| 5,580,737 A | 12/1996 | Polisky et al. |
| 5,614,365 A | 3/1997 | Tabor et al. |
| 5,652,094 A | 7/1997 | Usman et al. |
| 5,658,727 A | 8/1997 | Barbas et al. |
| 5,668,005 A | 9/1997 | Gerard et al. |
| 5,677,152 A | 10/1997 | Birch et al. |
| 5,767,099 A | 6/1998 | Harris et al. |
| 5,780,053 A | 7/1998 | Ashley et al. |
| 5,830,430 A | 11/1998 | Unger et al. |
| 5,834,247 A | 11/1998 | Comb et al. |
| 5,835,699 A | 11/1998 | Kimura |
| 5,844,075 A | 12/1998 | Kawakami et al. |
| 5,849,548 A | 12/1998 | Haseloff et al. |
| 5,851,548 A | 12/1998 | Dattagupta et al. |
| 5,855,910 A | 1/1999 | Ashley et al. |
| 5,856,463 A | 1/1999 | Blankenborg et al. |
| 5,962,313 A | 10/1999 | Podsakoff et al. |
| 5,981,182 A | 11/1999 | Jacobs, Jr. et al. |
| 6,015,794 A | 1/2000 | Haseloff et al. |
| 6,057,153 A | 5/2000 | George et al. |
| 6,063,608 A | 5/2000 | Kotewicz et al. |
| 6,077,705 A | 6/2000 | Duan et al. |
| 6,156,509 A | 12/2000 | Schellenberger |
| 6,183,998 B1 | 2/2001 | Ivanov et al. |
| 6,355,415 B1 | 3/2002 | Wagner et al. |
| 6,429,298 B1 | 8/2002 | Ellington et al. |
| 6,453,242 B1 | 9/2002 | Eisenberg et al. |
| 6,479,264 B1 | 11/2002 | Louwrier |
| 6,503,717 B2 | 1/2003 | Case et al. |
| 6,534,261 B1 | 3/2003 | Cox, III et al. |
| 6,589,768 B1 | 7/2003 | Kotewicz et al. |
| 6,599,692 B1 | 7/2003 | Case et al. |
| 6,607,882 B1 | 8/2003 | Cox, III et al. |
| 6,610,522 B1 | 8/2003 | Kotewicz et al. |
| 6,689,558 B2 | 2/2004 | Case |
| 6,716,973 B2 | 4/2004 | Baskerville et al. |
| 6,824,978 B1 | 11/2004 | Cox, III et al. |
| 6,933,113 B2 | 8/2005 | Case et al. |
| 6,979,539 B2 | 12/2005 | Cox, III et al. |
| 7,013,219 B2 | 3/2006 | Case et al. |
| 7,045,337 B2 | 5/2006 | Schultz et al. |
| 7,067,650 B1 | 6/2006 | Tanaka |
| 7,070,928 B2 | 7/2006 | Liu et al. |
| 7,078,208 B2 | 7/2006 | Smith et al. |
| 7,083,970 B2 | 8/2006 | Schultz et al. |
| 7,163,824 B2 | 1/2007 | Cox, III et al. |
| 7,192,739 B2 | 3/2007 | Liu et al. |
| 7,223,545 B2 | 5/2007 | Liu et al. |
| 7,354,761 B2 | 4/2008 | Schultz et al. |
| 7,368,275 B2 | 5/2008 | Schultz et al. |
| 7,442,160 B2 | 10/2008 | Liu et al. |
| 7,476,500 B1 | 1/2009 | Liu et al. |
| 7,476,734 B2 | 1/2009 | Liu |
| 7,479,573 B2 | 1/2009 | Chu et al. |
| 7,491,494 B2 | 2/2009 | Liu et al. |
| 7,541,450 B2 | 6/2009 | Liu et al. |
| 7,557,068 B2 | 7/2009 | Liu et al. |
| 7,595,179 B2 | 9/2009 | Chen et al. |
| 7,638,300 B2 | 12/2009 | Schultz et al. |
| 7,670,807 B2 | 3/2010 | Lampson et al. |
| 7,678,554 B2 | 3/2010 | Liu et al. |
| 7,713,721 B2 | 5/2010 | Schultz et al. |
| 7,771,935 B2 | 8/2010 | Liu et al. |
| 7,794,931 B2 | 9/2010 | Breaker et al. |
| 7,807,408 B2 | 10/2010 | Liu et al. |
| 7,851,658 B2 | 12/2010 | Liu et al. |
| 7,915,025 B2 | 3/2011 | Schultz et al. |
| 7,919,277 B2 | 4/2011 | Russell et al. |
| 7,993,672 B2 | 8/2011 | Huang et al. |
| 7,998,904 B2 | 8/2011 | Liu et al. |
| 8,012,739 B2 | 9/2011 | Schultz et al. |
| 8,017,323 B2 | 9/2011 | Liu et al. |
| 8,017,755 B2 | 9/2011 | Liu et al. |
| 8,030,074 B2 | 10/2011 | Schultz et al. |
| 8,067,556 B2 | 11/2011 | Hogrefe et al. |
| 8,114,648 B2 | 2/2012 | Schultz et al. |
| 8,173,364 B2 | 5/2012 | Schultz et al. |
| 8,173,392 B2 | 5/2012 | Schultz et al. |
| 8,183,012 B2 | 5/2012 | Schultz et al. |
| 8,183,178 B2 | 5/2012 | Liu et al. |
| 8,206,914 B2 | 6/2012 | Liu et al. |
| 8,361,725 B2 | 1/2013 | Russell et al. |
| 8,394,604 B2 | 3/2013 | Liu et al. |
| 8,440,431 B2 | 5/2013 | Voytas et al. |
| 8,440,432 B2 | 5/2013 | Voytas et al. |
| 8,450,471 B2 | 5/2013 | Voytas et al. |
| 8,492,082 B2 | 7/2013 | De Franciscis et al. |
| 8,546,553 B2 | 10/2013 | Terns et al. |
| 8,569,256 B2 | 10/2013 | Heyes et al. |
| 8,586,363 B2 | 11/2013 | Voytas et al. |
| 8,680,069 B2 | 3/2014 | de Fougerolles et al. |
| 8,691,729 B2 | 4/2014 | Liu et al. |
| 8,691,750 B2 | 4/2014 | Constien et al. |
| 8,697,359 B1 | 4/2014 | Zhang |
| 8,697,853 B2 | 4/2014 | Voytas et al. |
| 8,709,466 B2 | 4/2014 | Coady et al. |
| 8,728,526 B2 | 5/2014 | Heller |
| 8,748,667 B2 | 6/2014 | Budzik et al. |
| 8,758,810 B2 | 6/2014 | Okada et al. |
| 8,759,103 B2 | 6/2014 | Kim et al. |
| 8,759,104 B2 | 6/2014 | Unciti-Broceta et al. |
| 8,771,728 B2 | 7/2014 | Huang et al. |
| 8,790,664 B2 | 7/2014 | Pitard et al. |
| 8,795,965 B2 | 8/2014 | Zhang |
| 8,822,663 B2 | 9/2014 | Schrum et al. |
| 8,835,148 B2 | 9/2014 | Janulaitis et al. |
| 8,846,578 B2 | 9/2014 | McCray et al. |
| 8,871,445 B2 | 10/2014 | Cong et al. |
| 8,900,814 B2 | 12/2014 | Yasukawa et al. |
| 8,945,839 B2 | 2/2015 | Zhang |
| 8,975,232 B2 | 3/2015 | Liu et al. |
| 8,993,233 B2 | 3/2015 | Zhang et al. |
| 8,999,641 B2 | 4/2015 | Zhang et al. |
| 9,023,594 B2 | 5/2015 | Liu et al. |
| 9,023,649 B2 | 5/2015 | Mali et al. |
| 9,034,650 B2 | 5/2015 | Padidam |
| 9,068,179 B1 | 6/2015 | Liu et al. |
| 9,150,626 B2 | 10/2015 | Liu et al. |
| 9,163,271 B2 | 10/2015 | Schultz et al. |
| 9,163,284 B2 | 10/2015 | Liu et al. |
| 9,181,535 B2 | 11/2015 | Liu et al. |
| 9,200,045 B2 | 12/2015 | Liu et al. |
| 9,221,886 B2 | 12/2015 | Liu et al. |
| 9,228,207 B2 | 1/2016 | Liu et al. |
| 9,234,213 B2 | 1/2016 | Wu |
| 9,243,038 B2 | 1/2016 | Liu et al. |
| 9,267,127 B2 | 2/2016 | Liu et al. |
| 9,322,006 B2 | 4/2016 | Liu et al. |
| 9,322,037 B2 | 4/2016 | Liu et al. |
| 9,340,799 B2 | 5/2016 | Liu et al. |
| 9,340,800 B2 | 5/2016 | Liu et al. |
| 9,359,599 B2 | 6/2016 | Liu et al. |
| 9,388,430 B2 | 7/2016 | Liu et al. |
| 9,394,537 B2 | 7/2016 | Liu et al. |
| 9,434,774 B2 | 9/2016 | Liu et al. |

(56) References Cited

U.S. PATENT DOCUMENTS

| | | |
|---|---|---|
| 9,458,484 B2 | 10/2016 | Ma et al. |
| 9,512,446 B1 | 12/2016 | Joung et al. |
| 9,526,724 B2 | 12/2016 | Oshlack et al. |
| 9,526,784 B2 | 12/2016 | Liu et al. |
| 9,534,210 B2 | 1/2017 | Park et al. |
| 9,580,698 B1 | 2/2017 | Xu et al. |
| 9,610,322 B2 | 4/2017 | Liu et al. |
| 9,637,739 B2 | 5/2017 | Šikšnys et al. |
| 9,663,770 B2 | 5/2017 | Rogers et al. |
| 9,737,604 B2 | 8/2017 | Liu et al. |
| 9,738,693 B2 | 8/2017 | Telford et al. |
| 9,753,340 B2 | 9/2017 | Saitou |
| 9,771,574 B2 | 9/2017 | Liu et al. |
| 9,783,791 B2 | 10/2017 | Hogrefe et al. |
| 9,816,093 B1 | 11/2017 | Donohoue et al. |
| 9,840,538 B2 | 12/2017 | Telford et al. |
| 9,840,690 B2 | 12/2017 | Karli et al. |
| 9,840,699 B2 | 12/2017 | Liu et al. |
| 9,840,702 B2 | 12/2017 | Collingwood et al. |
| 9,850,521 B2 | 12/2017 | Braman et al. |
| 9,873,907 B2 | 1/2018 | Zeiner et al. |
| 9,879,270 B2 | 1/2018 | Hittinger et al. |
| 9,914,939 B2 | 3/2018 | Church et al. |
| 9,932,567 B1 | 4/2018 | Xu et al. |
| 9,938,288 B1 | 4/2018 | Kishi et al. |
| 9,944,933 B2 | 4/2018 | Storici et al. |
| 9,982,279 B1 | 5/2018 | Gill et al. |
| 9,999,671 B2 | 6/2018 | Liu et al. |
| 10,011,868 B2 | 7/2018 | Liu et al. |
| 10,053,725 B2 | 8/2018 | Liu et al. |
| 10,059,940 B2 | 8/2018 | Zhong |
| 10,077,453 B2 | 9/2018 | Liu et al. |
| 10,113,163 B2 | 10/2018 | Liu et al. |
| 10,150,955 B2 | 12/2018 | Lambowitz et al. |
| 10,167,457 B2 | 1/2019 | Liu et al. |
| 10,179,911 B2 | 1/2019 | Liu et al. |
| 10,189,831 B2 | 1/2019 | Arrington et al. |
| 10,202,593 B2 | 2/2019 | Liu et al. |
| 10,202,658 B2 | 2/2019 | Parkin et al. |
| 10,227,581 B2 | 3/2019 | Liu et al. |
| 10,323,236 B2 | 6/2019 | Liu et al. |
| 10,336,997 B2 | 7/2019 | Liu et al. |
| 10,358,670 B2 | 7/2019 | Janulaitis et al. |
| 10,392,674 B2 | 8/2019 | Liu et al. |
| 10,407,697 B2 | 9/2019 | Doudna et al. |
| 10,465,176 B2 | 11/2019 | Liu et al. |
| 10,508,298 B2 | 12/2019 | Liu et al. |
| 10,583,201 B2 | 3/2020 | Chen et al. |
| 10,597,679 B2 | 3/2020 | Liu et al. |
| 10,612,011 B2 | 4/2020 | Liu et al. |
| 10,640,767 B2 | 5/2020 | Maianti et al. |
| 10,682,410 B2 | 6/2020 | Liu et al. |
| 10,704,062 B2 | 7/2020 | Liu et al. |
| 10,745,677 B2 | 8/2020 | Maianti et al. |
| 10,858,639 B2 | 12/2020 | Liu et al. |
| 10,912,833 B2 | 2/2021 | Liu et al. |
| 10,930,367 B2 | 2/2021 | Zhang et al. |
| 10,947,530 B2 | 3/2021 | Liu et al. |
| 10,954,548 B2 | 3/2021 | Liu et al. |
| 11,046,948 B2 | 6/2021 | Liu et al. |
| 11,053,481 B2 | 7/2021 | Liu et al. |
| 11,124,782 B2 | 9/2021 | Liu et al. |
| 11,214,780 B2 | 1/2022 | Liu et al. |
| 11,268,082 B2 | 3/2022 | Liu et al. |
| 11,299,755 B2 | 4/2022 | Liu et al. |
| 11,306,324 B2 | 4/2022 | Liu et al. |
| 11,319,532 B2 | 5/2022 | Liu et al. |
| 11,447,770 B1 | 9/2022 | Liu et al. |
| 11,542,496 B2 | 1/2023 | Liu et al. |
| 11,542,509 B2 | 1/2023 | Maianti et al. |
| 11,560,566 B2 | 1/2023 | Liu et al. |
| 11,578,343 B2 | 2/2023 | Liu et al. |
| 11,643,652 B2 | 5/2023 | Liu et al. |
| 11,661,590 B2 | 5/2023 | Liu et al. |
| 11,702,651 B2 | 7/2023 | Liu et al. |
| 11,732,274 B2 | 8/2023 | Liu et al. |
| 11,795,443 B2 | 10/2023 | Liu et al. |
| 11,795,452 B2 | 10/2023 | Liu et al. |
| 11,820,969 B2 | 11/2023 | Maianti et al. |
| 11,898,179 B2 | 2/2024 | Maianti et al. |
| 11,912,985 B2 | 2/2024 | Liu et al. |
| 11,920,181 B2 | 3/2024 | Liu et al. |
| 11,932,884 B2 | 3/2024 | Liu et al. |
| 2003/0082575 A1 | 5/2003 | Schultz et al. |
| 2003/0087817 A1 | 5/2003 | Cox et al. |
| 2003/0096337 A1 | 5/2003 | Hillman et al. |
| 2003/0108885 A1 | 6/2003 | Schultz et al. |
| 2003/0119764 A1 | 6/2003 | Loeb et al. |
| 2003/0167533 A1 | 9/2003 | Yadav et al. |
| 2003/0203480 A1 | 10/2003 | Kovesdi et al. |
| 2004/0003420 A1 | 1/2004 | Kuhn et al. |
| 2004/0115184 A1 | 6/2004 | Smith et al. |
| 2004/0197892 A1 | 10/2004 | Moore et al. |
| 2004/0203109 A1 | 10/2004 | Lal et al. |
| 2005/0136429 A1 | 6/2005 | Guarente et al. |
| 2005/0222030 A1 | 10/2005 | Allison |
| 2005/0260626 A1 | 11/2005 | Lorens et al. |
| 2006/0088864 A1 | 4/2006 | Smolke et al. |
| 2006/0104984 A1 | 5/2006 | Littlefield et al. |
| 2006/0246568 A1 | 11/2006 | Honjo et al. |
| 2007/0015238 A1 | 1/2007 | Snyder et al. |
| 2007/0264692 A1 | 11/2007 | Liu et al. |
| 2007/0269817 A1 | 11/2007 | Shapero |
| 2008/0008697 A1 | 1/2008 | Mintier et al. |
| 2008/0051317 A1 | 2/2008 | Church et al. |
| 2008/0124725 A1 | 5/2008 | Barrangou et al. |
| 2008/0182254 A1 | 7/2008 | Hall et al. |
| 2008/0220502 A1 | 9/2008 | Schellenberger et al. |
| 2008/0241917 A1 | 10/2008 | Akita et al. |
| 2008/0268516 A1 | 10/2008 | Perreault et al. |
| 2009/0111119 A1 | 4/2009 | Doyon et al. |
| 2009/0130718 A1 | 5/2009 | Short |
| 2009/0215878 A1 | 8/2009 | Tan et al. |
| 2009/0234109 A1 | 9/2009 | Han et al. |
| 2010/0076057 A1 | 3/2010 | Sontheimer et al. |
| 2010/0093617 A1 | 4/2010 | Barrangou et al. |
| 2010/0104690 A1 | 4/2010 | Barrangou et al. |
| 2010/0273857 A1 | 10/2010 | Thakker et al. |
| 2010/0305197 A1 | 12/2010 | Che |
| 2010/0316643 A1 | 12/2010 | Eckert et al. |
| 2011/0016540 A1 | 1/2011 | Weinstein et al. |
| 2011/0059160 A1 | 3/2011 | Essner et al. |
| 2011/0059502 A1 | 3/2011 | Chalasani |
| 2011/0104787 A1 | 5/2011 | Church et al. |
| 2011/0177495 A1 | 7/2011 | Liu et al. |
| 2011/0189776 A1 | 8/2011 | Terns et al. |
| 2011/0217739 A1 | 9/2011 | Terns et al. |
| 2011/0301073 A1 | 12/2011 | Gregory et al. |
| 2012/0129759 A1 | 5/2012 | Liu et al. |
| 2012/0141523 A1 | 6/2012 | Castado et al. |
| 2012/0244601 A1 | 9/2012 | Bertozzi et al. |
| 2012/0270273 A1 | 10/2012 | Zhang et al. |
| 2012/0322861 A1 | 12/2012 | Byrne et al. |
| 2013/0022980 A1 | 1/2013 | Nelson et al. |
| 2013/0059931 A1 | 3/2013 | Petersen-Mahrt et al. |
| 2013/0117869 A1 | 5/2013 | Duchateau et al. |
| 2013/0130248 A1 | 5/2013 | Haurwitz et al. |
| 2013/0158245 A1 | 6/2013 | Russell et al. |
| 2013/0165389 A1 | 6/2013 | Schellenberger et al. |
| 2013/0212725 A1 | 8/2013 | Kuhn et al. |
| 2013/0309720 A1 | 11/2013 | Schultz et al. |
| 2013/0344117 A1 | 12/2013 | Mirosevich et al. |
| 2013/0345064 A1 | 12/2013 | Liu et al. |
| 2014/0004280 A1 | 1/2014 | Loomis |
| 2014/0005269 A1 | 1/2014 | Ngwuluka et al. |
| 2014/0017214 A1 | 1/2014 | Cost |
| 2014/0018404 A1 | 1/2014 | Chen et al. |
| 2014/0044793 A1 | 2/2014 | Goll et al. |
| 2014/0065711 A1 | 3/2014 | Liu et al. |
| 2014/0068797 A1 | 3/2014 | Doudna et al. |
| 2014/0127752 A1 | 5/2014 | Zhou et al. |
| 2014/0128449 A1 | 5/2014 | Liu et al. |
| 2014/0141094 A1 | 5/2014 | Smyth et al. |
| 2014/0141487 A1 | 5/2014 | Feldman et al. |

(56) References Cited

U.S. PATENT DOCUMENTS

| | | |
|---|---|---|
| 2014/0179770 A1 | 6/2014 | Zhang et al. |
| 2014/0186843 A1 | 7/2014 | Zhang et al. |
| 2014/0186919 A1 | 7/2014 | Zhang et al. |
| 2014/0186958 A1 | 7/2014 | Zhang et al. |
| 2014/0201858 A1 | 7/2014 | Ostertag et al. |
| 2014/0234289 A1 | 8/2014 | Liu et al. |
| 2014/0248702 A1 | 9/2014 | Zhang et al. |
| 2014/0273037 A1 | 9/2014 | Wu |
| 2014/0273226 A1 | 9/2014 | Wu |
| 2014/0273230 A1 | 9/2014 | Chen et al. |
| 2014/0283156 A1 | 9/2014 | Zador et al. |
| 2014/0295556 A1 | 10/2014 | Joung et al. |
| 2014/0295557 A1 | 10/2014 | Joung et al. |
| 2014/0342456 A1 | 11/2014 | Mali et al. |
| 2014/0342457 A1 | 11/2014 | Mali et al. |
| 2014/0342458 A1 | 11/2014 | Mali et al. |
| 2014/0349400 A1 | 11/2014 | Jakimo et al. |
| 2014/0356867 A1 | 12/2014 | Peter et al. |
| 2014/0356956 A1 | 12/2014 | Church et al. |
| 2014/0356958 A1 | 12/2014 | Mali et al. |
| 2014/0356959 A1 | 12/2014 | Church et al. |
| 2014/0357523 A1 | 12/2014 | Zeiner et al. |
| 2014/0377868 A1 | 12/2014 | Joung et al. |
| 2015/0010526 A1 | 1/2015 | Liu et al. |
| 2015/0031089 A1 | 1/2015 | Lindstrom |
| 2015/0031132 A1 | 1/2015 | Church et al. |
| 2015/0031133 A1 | 1/2015 | Church et al. |
| 2015/0044191 A1 | 2/2015 | Liu et al. |
| 2015/0044192 A1 | 2/2015 | Liu et al. |
| 2015/0044772 A1 | 2/2015 | Zhao |
| 2015/0050699 A1 | 2/2015 | Siksnys et al. |
| 2015/0056177 A1 | 2/2015 | Liu et al. |
| 2015/0056629 A1 | 2/2015 | Guthrie-Honea |
| 2015/0064138 A1 | 3/2015 | Lu et al. |
| 2015/0064789 A1 | 3/2015 | Paschon et al. |
| 2015/0071898 A1 | 3/2015 | Liu et al. |
| 2015/0071899 A1 | 3/2015 | Liu et al. |
| 2015/0071900 A1 | 3/2015 | Liu et al. |
| 2015/0071901 A1 | 3/2015 | Liu et al. |
| 2015/0071902 A1 | 3/2015 | Liu et al. |
| 2015/0071903 A1 | 3/2015 | Liu et al. |
| 2015/0071906 A1 | 3/2015 | Liu et al. |
| 2015/0079680 A1 | 3/2015 | Bradley et al. |
| 2015/0079681 A1 | 3/2015 | Zhang |
| 2015/0098954 A1 | 4/2015 | Hyde et al. |
| 2015/0118216 A1 | 4/2015 | Liu et al. |
| 2015/0128300 A1 | 5/2015 | Warming et al. |
| 2015/0132269 A1 | 5/2015 | Orkin et al. |
| 2015/0140664 A1 | 5/2015 | Byrne et al. |
| 2015/0159172 A1 | 6/2015 | Miller et al. |
| 2015/0165054 A1 | 6/2015 | Liu et al. |
| 2015/0166980 A1 | 6/2015 | Liu et al. |
| 2015/0166981 A1 | 6/2015 | Liu et al. |
| 2015/0166982 A1 | 6/2015 | Liu et al. |
| 2015/0166984 A1 | 6/2015 | Liu et al. |
| 2015/0166985 A1 | 6/2015 | Liu et al. |
| 2015/0191744 A1 | 7/2015 | Wolfe et al. |
| 2015/0197759 A1 | 7/2015 | Xu et al. |
| 2015/0211058 A1 | 7/2015 | Carstens |
| 2015/0218573 A1 | 8/2015 | Loque et al. |
| 2015/0225773 A1 | 8/2015 | Farmer et al. |
| 2015/0252358 A1 | 9/2015 | Maeder et al. |
| 2015/0275202 A1 | 10/2015 | Liu et al. |
| 2015/0291965 A1 | 10/2015 | Zhang et al. |
| 2015/0307889 A1 | 10/2015 | Petolino et al. |
| 2015/0315252 A1 | 11/2015 | Haugwitz et al. |
| 2015/0344549 A1 | 12/2015 | Muir et al. |
| 2016/0015682 A2 | 1/2016 | Cawthorne et al. |
| 2016/0017393 A1 | 1/2016 | Jacobson et al. |
| 2016/0017396 A1 | 1/2016 | Cann et al. |
| 2016/0032292 A1 | 2/2016 | Storici et al. |
| 2016/0032353 A1 | 2/2016 | Braman et al. |
| 2016/0040155 A1 | 2/2016 | Maizels et al. |
| 2016/0046952 A1 | 2/2016 | Hittinger et al. |
| 2016/0046961 A1 | 2/2016 | Jinek et al. |
| 2016/0046962 A1 | 2/2016 | May et al. |
| 2016/0053272 A1 | 2/2016 | Wurtzel et al. |
| 2016/0053304 A1 | 2/2016 | Wurtzel et al. |
| 2016/0074535 A1 | 3/2016 | Ranganathan et al. |
| 2016/0076093 A1 | 3/2016 | Shendure et al. |
| 2016/0090603 A1 | 3/2016 | Carnes et al. |
| 2016/0090622 A1 | 3/2016 | Liu et al. |
| 2016/0115488 A1 | 4/2016 | Zhang et al. |
| 2016/0138046 A1 | 5/2016 | Wu |
| 2016/0153003 A1 | 6/2016 | Joung et al. |
| 2016/0186214 A1 | 6/2016 | Brouns et al. |
| 2016/0200779 A1 | 7/2016 | Liu et al. |
| 2016/0201040 A1 | 7/2016 | Liu et al. |
| 2016/0201089 A1 | 7/2016 | Gersbach et al. |
| 2016/0206566 A1 | 7/2016 | Lu et al. |
| 2016/0208243 A1 | 7/2016 | Zhang et al. |
| 2016/0208288 A1 | 7/2016 | Liu et al. |
| 2016/0215275 A1 | 7/2016 | Zhong |
| 2016/0215276 A1 | 7/2016 | Liu et al. |
| 2016/0215300 A1 | 7/2016 | May et al. |
| 2016/0244784 A1 | 8/2016 | Jacobson et al. |
| 2016/0244829 A1 | 8/2016 | Bang et al. |
| 2016/0264934 A1 | 9/2016 | Giallourakis et al. |
| 2016/0272965 A1 | 9/2016 | Zhang et al. |
| 2016/0281072 A1 | 9/2016 | Zhang |
| 2016/0298136 A1 | 10/2016 | Chen et al. |
| 2016/0304846 A1 | 10/2016 | Liu et al. |
| 2016/0304855 A1 | 10/2016 | Stark et al. |
| 2016/0312304 A1 | 10/2016 | Sorrentino et al. |
| 2016/0319262 A1 | 11/2016 | Doudna et al. |
| 2016/0333389 A1 | 11/2016 | Liu et al. |
| 2016/0340622 A1 | 11/2016 | Abdou |
| 2016/0340662 A1 | 11/2016 | Zhang et al. |
| 2016/0345578 A1 | 12/2016 | Barrangou et al. |
| 2016/0346360 A1 | 12/2016 | Quake et al. |
| 2016/0346361 A1 | 12/2016 | Quake et al. |
| 2016/0346362 A1 | 12/2016 | Quake et al. |
| 2016/0348074 A1 | 12/2016 | Quake et al. |
| 2016/0348096 A1 | 12/2016 | Liu et al. |
| 2016/0350476 A1 | 12/2016 | Quake et al. |
| 2016/0355796 A1 | 12/2016 | Davidson et al. |
| 2016/0369262 A1 | 12/2016 | Reik et al. |
| 2017/0009224 A1 | 1/2017 | Liu et al. |
| 2017/0009242 A1 | 1/2017 | McKinley et al. |
| 2017/0014449 A1 | 1/2017 | Bangera et al. |
| 2017/0020922 A1 | 1/2017 | Wagner et al. |
| 2017/0022251 A1 | 1/2017 | Rammensee et al. |
| 2017/0037432 A1 | 2/2017 | Donohoue et al. |
| 2017/0044520 A1 | 2/2017 | Liu et al. |
| 2017/0044592 A1 | 2/2017 | Peter et al. |
| 2017/0053729 A1 | 2/2017 | Kotani et al. |
| 2017/0058271 A1 | 3/2017 | Joung et al. |
| 2017/0058272 A1 | 3/2017 | Carter et al. |
| 2017/0058298 A1 | 3/2017 | Kennedy et al. |
| 2017/0073663 A1 | 3/2017 | Wang et al. |
| 2017/0073670 A1 | 3/2017 | Nishida et al. |
| 2017/0087224 A1 | 3/2017 | Quake |
| 2017/0087225 A1 | 3/2017 | Quake |
| 2017/0088587 A1 | 3/2017 | Quake |
| 2017/0088828 A1 | 3/2017 | Quake |
| 2017/0107536 A1 | 4/2017 | Zhang et al. |
| 2017/0107560 A1 | 4/2017 | Peter et al. |
| 2017/0114367 A1 | 4/2017 | Hu et al. |
| 2017/0121693 A1 | 5/2017 | Liu et al. |
| 2017/0145394 A1 | 5/2017 | Yeo et al. |
| 2017/0145405 A1 | 5/2017 | Tang et al. |
| 2017/0145438 A1 | 5/2017 | Kantor |
| 2017/0152528 A1 | 6/2017 | Zhang |
| 2017/0152787 A1 | 6/2017 | Kubo et al. |
| 2017/0159033 A1 | 6/2017 | Kamtekar et al. |
| 2017/0166928 A1 | 6/2017 | Vyas et al. |
| 2017/0175104 A1 | 6/2017 | Doudna et al. |
| 2017/0175142 A1 | 6/2017 | Zhang et al. |
| 2017/0191047 A1 | 7/2017 | Terns et al. |
| 2017/0191078 A1 | 7/2017 | Zhang et al. |
| 2017/0198269 A1 | 7/2017 | Zhang et al. |
| 2017/0198277 A1 | 7/2017 | Kmiec et al. |
| 2017/0198302 A1 | 7/2017 | Feng et al. |
| 2017/0211061 A1 | 7/2017 | Weiss et al. |

(56) References Cited

U.S. PATENT DOCUMENTS

| | | |
|---|---|---|
| 2017/0224843 A1 | 8/2017 | Deglon et al. |
| 2017/0226522 A1 | 8/2017 | Hu et al. |
| 2017/0233703 A1 | 8/2017 | Xie et al. |
| 2017/0233708 A1 | 8/2017 | Liu et al. |
| 2017/0233756 A1 | 8/2017 | Begemann et al. |
| 2017/0247671 A1 | 8/2017 | Yung et al. |
| 2017/0247703 A1 | 8/2017 | Sloan et al. |
| 2017/0268022 A1 | 9/2017 | Liu et al. |
| 2017/0275648 A1 | 9/2017 | Barrangou et al. |
| 2017/0275665 A1 | 9/2017 | Silas et al. |
| 2017/0283797 A1 | 10/2017 | Robb et al. |
| 2017/0283831 A1 | 10/2017 | Zhang et al. |
| 2017/0306306 A1 | 10/2017 | Potter et al. |
| 2017/0314016 A1 | 11/2017 | Kim et al. |
| 2017/0362635 A1 | 12/2017 | Chamberlain et al. |
| 2018/0064077 A1 | 3/2018 | Dunham et al. |
| 2018/0066258 A1 | 3/2018 | Powell |
| 2018/0068062 A1 | 3/2018 | Zhang et al. |
| 2018/0073012 A1 | 3/2018 | Liu et al. |
| 2018/0080051 A1 | 3/2018 | Sheikh et al. |
| 2018/0087046 A1 | 3/2018 | Badran et al. |
| 2018/0100147 A1 | 4/2018 | Yates et al. |
| 2018/0105867 A1 | 4/2018 | Xiao et al. |
| 2018/0119118 A1 | 5/2018 | Lu et al. |
| 2018/0127780 A1 | 5/2018 | Liu et al. |
| 2018/0155708 A1 | 6/2018 | Church et al. |
| 2018/0155720 A1 | 6/2018 | Donohoue et al. |
| 2018/0163213 A1 | 6/2018 | Aneja et al. |
| 2018/0170984 A1 | 6/2018 | Harris et al. |
| 2018/0179503 A1 | 6/2018 | Maianti et al. |
| 2018/0179547 A1 | 6/2018 | Zhang et al. |
| 2018/0201921 A1 | 7/2018 | Malcolm |
| 2018/0230464 A1 | 8/2018 | Zhong |
| 2018/0230471 A1 | 8/2018 | Storici et al. |
| 2018/0236081 A1 | 8/2018 | Liu et al. |
| 2018/0237758 A1 | 8/2018 | Liu et al. |
| 2018/0237787 A1 | 8/2018 | Maianti et al. |
| 2018/0245066 A1 | 8/2018 | Yao et al. |
| 2018/0245075 A1 | 8/2018 | Khalil et al. |
| 2018/0265864 A1 | 9/2018 | Li et al. |
| 2018/0273939 A1 | 9/2018 | Yu et al. |
| 2018/0282722 A1 | 10/2018 | Jakimo et al. |
| 2018/0298391 A1 | 10/2018 | Jakimo et al. |
| 2018/0305688 A1 | 10/2018 | Zhong |
| 2018/0305704 A1 | 10/2018 | Zhang |
| 2018/0312822 A1 | 11/2018 | Lee et al. |
| 2018/0312825 A1 | 11/2018 | Liu et al. |
| 2018/0312828 A1 | 11/2018 | Liu et al. |
| 2018/0312835 A1 | 11/2018 | Yao et al. |
| 2018/0327756 A1 | 11/2018 | Zhang et al. |
| 2018/0371497 A1 | 12/2018 | Gill et al. |
| 2019/0010481 A1 | 1/2019 | Joung et al. |
| 2019/0055543 A1 | 2/2019 | Tran et al. |
| 2019/0055549 A1 | 2/2019 | Capurso et al. |
| 2019/0062734 A1 | 2/2019 | Cotta-Ramusino et al. |
| 2019/0093099 A1 | 3/2019 | Liu et al. |
| 2019/0185883 A1 | 6/2019 | Liu et al. |
| 2019/0218547 A1 | 7/2019 | Lee et al. |
| 2019/0225955 A1 | 7/2019 | Liu et al. |
| 2019/0233847 A1 | 8/2019 | Savage et al. |
| 2019/0241633 A1 | 8/2019 | Fotin-Mleczek et al. |
| 2019/0256842 A1 | 8/2019 | Liu et al. |
| 2019/0264202 A1 | 8/2019 | Church et al. |
| 2019/0276816 A1 | 9/2019 | Liu et al. |
| 2019/0309290 A1 | 10/2019 | Neuteboom et al. |
| 2019/0322992 A1 | 10/2019 | Liu et al. |
| 2019/0330619 A1 | 10/2019 | Smith et al. |
| 2019/0352632 A1 | 11/2019 | Liu et al. |
| 2019/0367891 A1 | 12/2019 | Liu et al. |
| 2020/0010818 A1 | 1/2020 | Liu et al. |
| 2020/0010835 A1 | 1/2020 | Maianti et al. |
| 2020/0056206 A1 | 2/2020 | Tremblay et al. |
| 2020/0063127 A1 | 2/2020 | Lu et al. |
| 2020/0071722 A1 | 3/2020 | Liu et al. |
| 2020/0109398 A1 | 4/2020 | Rubens et al. |
| 2020/0172931 A1 | 6/2020 | Liu et al. |
| 2020/0181619 A1 | 6/2020 | Tang et al. |
| 2020/0190493 A1 | 6/2020 | Liu et al. |
| 2020/0216833 A1 | 7/2020 | Liu et al. |
| 2020/0255868 A1 | 8/2020 | Liu et al. |
| 2020/0277587 A1 | 9/2020 | Liu et al. |
| 2020/0318116 A1 | 10/2020 | Freier |
| 2020/0323984 A1 | 10/2020 | Liu et al. |
| 2020/0399619 A1 | 12/2020 | Maianti et al. |
| 2020/0399626 A1 | 12/2020 | Liu et al. |
| 2021/0054416 A1 | 2/2021 | Liu et al. |
| 2021/0115428 A1 | 4/2021 | Maianti et al. |
| 2021/0196809 A1 | 7/2021 | Maianti et al. |
| 2021/0214698 A1 | 7/2021 | Liu et al. |
| 2021/0230577 A1 | 7/2021 | Liu et al. |
| 2021/0254127 A1 | 8/2021 | Liu et al. |
| 2021/0315994 A1 | 10/2021 | Liu et al. |
| 2021/0317440 A1 | 10/2021 | Liu et al. |
| 2021/0380955 A1* | 12/2021 | Bryson ............... A61K 38/57 |
| 2022/0033785 A1 | 2/2022 | Liu et al. |
| 2022/0119785 A1 | 4/2022 | Liu et al. |
| 2022/0170013 A1 | 6/2022 | Liu et al. |
| 2022/0177877 A1 | 6/2022 | Church et al. |
| 2022/0204975 A1 | 6/2022 | Liu et al. |
| 2022/0213507 A1 | 7/2022 | Liu et al. |
| 2022/0220462 A1 | 7/2022 | Liu et al. |
| 2022/0238182 A1 | 7/2022 | Shen et al. |
| 2022/0249697 A1 | 8/2022 | Liu et al. |
| 2022/0282275 A1 | 9/2022 | Liu et al. |
| 2022/0290115 A1 | 9/2022 | Liu et al. |
| 2022/0307001 A1 | 9/2022 | Liu et al. |
| 2022/0307003 A1 | 9/2022 | Liu et al. |
| 2022/0315906 A1 | 10/2022 | Liu et al. |
| 2022/0356469 A1 | 11/2022 | Liu et al. |
| 2022/0380740 A1 | 12/2022 | Liu et al. |
| 2022/0389395 A1 | 12/2022 | Liu et al. |
| 2023/0002745 A1 | 1/2023 | Liu et al. |
| 2023/0021641 A1 | 1/2023 | Liu et al. |
| 2023/0056852 A1 | 2/2023 | Liu et al. |
| 2023/0058176 A1 | 2/2023 | Liu et al. |
| 2023/0078265 A1 | 3/2023 | Liu et al. |
| 2023/0086199 A1 | 3/2023 | Liu et al. |
| 2023/0090221 A1 | 3/2023 | Liu et al. |
| 2023/0108687 A1 | 4/2023 | Liu et al. |
| 2023/0123669 A1 | 4/2023 | Liu et al. |
| 2023/0127008 A1 | 4/2023 | Liu et al. |
| 2023/0159913 A1 | 5/2023 | Liu et al. |
| 2023/0193295 A1 | 6/2023 | Maianti et al. |
| 2023/0220374 A1 | 7/2023 | Liu et al. |
| 2023/0272425 A1 | 8/2023 | Liu et al. |
| 2023/0279443 A1 | 9/2023 | Liu et al. |
| 2023/0332144 A1 | 10/2023 | Liu et al. |
| 2023/0340465 A1 | 10/2023 | Liu et al. |
| 2023/0340466 A1 | 10/2023 | Liu et al. |
| 2023/0340467 A1 | 10/2023 | Liu et al. |
| 2023/0348883 A1 | 11/2023 | Liu et al. |
| 2023/0357766 A1 | 11/2023 | Liu et al. |
| 2023/0383289 A1 | 11/2023 | Liu et al. |
| 2024/0035017 A1 | 2/2024 | Liu et al. |
| 2024/0076652 A1 | 3/2024 | Liu et al. |

FOREIGN PATENT DOCUMENTS

| | | |
|---|---|---|
| AU | 2015252023 A1 | 11/2015 |
| AU | 2015101792 A4 | 1/2016 |
| BR | 112015013786 A2 | 7/2017 |
| CA | 2894668 A1 | 6/2014 |
| CA | 2894681 A1 | 6/2014 |
| CA | 2894684 A1 | 6/2014 |
| CA | 2 852 593 A1 | 11/2015 |
| CN | 1069962 A | 3/1993 |
| CN | 101460619 A | 6/2009 |
| CN | 101873862 A | 10/2010 |
| CN | 102892777 A | 1/2013 |
| CN | 103224947 A | 7/2013 |
| CN | 103233028 A | 8/2013 |
| CN | 103388006 A | 11/2013 |
| CN | 103614415 A | 3/2014 |
| CN | 103642836 A | 3/2014 |

(56) References Cited

FOREIGN PATENT DOCUMENTS

| | | | |
|---|---|---|---|
| CN | 103668472 A | 3/2014 |
| CN | 103820441 A | 5/2014 |
| CN | 103820454 A | 5/2014 |
| CN | 103911376 A | 7/2014 |
| CN | 103923911 A | 7/2014 |
| CN | 103088008 A | 8/2014 |
| CN | 103981211 A | 8/2014 |
| CN | 103981212 A | 8/2014 |
| CN | 104004778 A | 8/2014 |
| CN | 104004782 A | 8/2014 |
| CN | 104017821 A | 9/2014 |
| CN | 104109687 A | 10/2014 |
| CN | 104178461 A | 12/2014 |
| CN | 104342457 A | 2/2015 |
| CN | 104404036 A | 3/2015 |
| CN | 104450774 A | 3/2015 |
| CN | 104480144 A | 4/2015 |
| CN | 104498493 A | 4/2015 |
| CN | 104504304 A | 4/2015 |
| CN | 104531704 A | 4/2015 |
| CN | 104531705 A | 4/2015 |
| CN | 104560864 A | 4/2015 |
| CN | 104561095 A | 4/2015 |
| CN | 104593418 A | 5/2015 |
| CN | 104593422 A | 5/2015 |
| CN | 104611370 A | 5/2015 |
| CN | 104651392 A | 5/2015 |
| CN | 104651398 A | 5/2015 |
| CN | 104651399 A | 5/2015 |
| CN | 104651401 A | 5/2015 |
| CN | 104673816 A | 6/2015 |
| CN | 104725626 A | 6/2015 |
| CN | 104726449 A | 6/2015 |
| CN | 104726494 A | 6/2015 |
| CN | 104745626 A | 7/2015 |
| CN | 104762321 A | 7/2015 |
| CN | 104805078 A | 7/2015 |
| CN | 104805099 A | 7/2015 |
| CN | 104805118 A | 7/2015 |
| CN | 104846010 A | 8/2015 |
| CN | 104894068 A | 9/2015 |
| CN | 104894075 A | 9/2015 |
| CN | 104928321 A | 9/2015 |
| CN | 105039339 A | 11/2015 |
| CN | 105039399 A | 11/2015 |
| CN | 105063061 A | 11/2015 |
| CN | 105087620 A | 11/2015 |
| CN | 105112422 A | 12/2015 |
| CN | 105112445 A | 12/2015 |
| CN | 105112519 A | 12/2015 |
| CN | 105121648 A | 12/2015 |
| CN | 105132427 A | 12/2015 |
| CN | 105132451 A | 12/2015 |
| CN | 105177038 A | 12/2015 |
| CN | 105177126 A | 12/2015 |
| CN | 105210981 A | 1/2016 |
| CN | 105219799 A | 1/2016 |
| CN | 105238806 A | 1/2016 |
| CN | 105255937 A | 1/2016 |
| CN | 105274144 A | 1/2016 |
| CN | 105296518 A | 2/2016 |
| CN | 105296537 A | 2/2016 |
| CN | 105316324 A | 2/2016 |
| CN | 105316327 A | 2/2016 |
| CN | 105316337 A | 2/2016 |
| CN | 105331607 A | 2/2016 |
| CN | 105331608 A | 2/2016 |
| CN | 105331609 A | 2/2016 |
| CN | 105331627 A | 2/2016 |
| CN | 105400773 A | 3/2016 |
| CN | 105400779 A | 3/2016 |
| CN | 105400810 A | 3/2016 |
| CN | 105441451 A | 3/2016 |
| CN | 105462968 A | 4/2016 |
| CN | 105463003 A | 4/2016 |
| CN | 105463027 A | 4/2016 |
| CN | 105492608 A | 4/2016 |
| CN | 105492609 A | 4/2016 |
| CN | 105505976 A | 4/2016 |
| CN | 105505979 A | 4/2016 |
| CN | 105518134 A | 4/2016 |
| CN | 105518135 A | 4/2016 |
| CN | 105518137 A | 4/2016 |
| CN | 105518138 A | 4/2016 |
| CN | 105518139 A | 4/2016 |
| CN | 105518140 A | 4/2016 |
| CN | 105543228 A | 5/2016 |
| CN | 105543266 A | 5/2016 |
| CN | 105543270 A | 5/2016 |
| CN | 105567688 A | 5/2016 |
| CN | 105567689 A | 5/2016 |
| CN | 105567734 A | 5/2016 |
| CN | 105567735 A | 5/2016 |
| CN | 105567738 A | 5/2016 |
| CN | 105593367 A | 5/2016 |
| CN | 105594664 A | 5/2016 |
| CN | 105602987 A | 5/2016 |
| CN | 105624146 A | 6/2016 |
| CN | 105624187 A | 6/2016 |
| CN | 105646719 A | 6/2016 |
| CN | 105647922 A | 6/2016 |
| CN | 105647962 A | 6/2016 |
| CN | 105647968 A | 6/2016 |
| CN | 105647969 A | 6/2016 |
| CN | 105671070 A | 6/2016 |
| CN | 105671083 A | 6/2016 |
| CN | 105695485 A | 6/2016 |
| CN | 105779448 A | 7/2016 |
| CN | 105779449 A | 7/2016 |
| CN | 105802980 A | 7/2016 |
| CN | 105821039 A | 8/2016 |
| CN | 105821040 A | 8/2016 |
| CN | 105821049 A | 8/2016 |
| CN | 105821072 A | 8/2016 |
| CN | 105821075 A | 8/2016 |
| CN | 105821116 A | 8/2016 |
| CN | 105838733 A | 8/2016 |
| CN | 105861547 A | 8/2016 |
| CN | 105861552 A | 8/2016 |
| CN | 105861554 A | 8/2016 |
| CN | 105886498 A | 8/2016 |
| CN | 105886534 A | 8/2016 |
| CN | 105886616 A | 8/2016 |
| CN | 105907758 A | 8/2016 |
| CN | 105907785 A | 8/2016 |
| CN | 105925608 A | 9/2016 |
| CN | 105934516 A | 9/2016 |
| CN | 105950560 A | 9/2016 |
| CN | 105950626 A | 9/2016 |
| CN | 105950633 A | 9/2016 |
| CN | 105950639 A | 9/2016 |
| CN | 105985985 A | 10/2016 |
| CN | 106011104 A | 10/2016 |
| CN | 106011150 A | 10/2016 |
| CN | 106011167 A | 10/2016 |
| CN | 106011171 A | 10/2016 |
| CN | 106032540 A | 10/2016 |
| CN | 106047803 A | 10/2016 |
| CN | 106047877 A | 10/2016 |
| CN | 106047930 A | 10/2016 |
| CN | 106086008 A | 11/2016 |
| CN | 106086028 A | 11/2016 |
| CN | 106086061 A | 11/2016 |
| CN | 106086062 A | 11/2016 |
| CN | 106109417 A | 11/2016 |
| CN | 106119275 A | 11/2016 |
| CN | 106119283 A | 11/2016 |
| CN | 106148286 A | 11/2016 |
| CN | 106148370 A | 11/2016 |
| CN | 106148416 A | 11/2016 |
| CN | 106167525 A | 11/2016 |
| CN | 106167808 A | 11/2016 |
| CN | 106167810 A | 11/2016 |
| CN | 106167821 A | 11/2016 |

(56) References Cited

FOREIGN PATENT DOCUMENTS

| | | | |
|---|---|---|---|
| CN | 106172238 A | 12/2016 |
| CN | 106190903 A | 12/2016 |
| CN | 106191057 A | 12/2016 |
| CN | 106191061 A | 12/2016 |
| CN | 106191062 A | 12/2016 |
| CN | 106191064 A | 12/2016 |
| CN | 106191071 A | 12/2016 |
| CN | 106191099 A | 12/2016 |
| CN | 106191107 A | 12/2016 |
| CN | 106191113 A | 12/2016 |
| CN | 106191114 A | 12/2016 |
| CN | 106191116 A | 12/2016 |
| CN | 106191124 A | 12/2016 |
| CN | 106222177 A | 12/2016 |
| CN | 106222193 A | 12/2016 |
| CN | 106222203 A | 12/2016 |
| CN | 106244555 A | 12/2016 |
| CN | 106244557 A | 12/2016 |
| CN | 106244591 A | 12/2016 |
| CN | 106244609 A | 12/2016 |
| CN | 106282241 A | 1/2017 |
| CN | 106318934 A | 1/2017 |
| CN | 106318973 A | 1/2017 |
| CN | 106350540 A | 1/2017 |
| CN | 106367435 A | 2/2017 |
| CN | 106399306 A | 2/2017 |
| CN | 106399311 A | 2/2017 |
| CN | 106399360 A | 2/2017 |
| CN | 106399367 A | 2/2017 |
| CN | 106399375 A | 2/2017 |
| CN | 106399377 A | 2/2017 |
| CN | 106434651 A | 2/2017 |
| CN | 106434663 A | 2/2017 |
| CN | 106434688 A | 2/2017 |
| CN | 106434737 A | 2/2017 |
| CN | 106434748 A | 2/2017 |
| CN | 106434752 A | 2/2017 |
| CN | 106434782 A | 2/2017 |
| CN | 106446600 A | 2/2017 |
| CN | 106479985 A | 3/2017 |
| CN | 106480027 A | 3/2017 |
| CN | 106480036 A | 3/2017 |
| CN | 106480067 A | 3/2017 |
| CN | 106480080 A | 3/2017 |
| CN | 106480083 A | 3/2017 |
| CN | 106480097 A | 3/2017 |
| CN | 106544351 A | 3/2017 |
| CN | 106544353 A | 3/2017 |
| CN | 106544357 A | 3/2017 |
| CN | 106554969 A | 4/2017 |
| CN | 106566838 A | 4/2017 |
| CN | 106701763 A | 5/2017 |
| CN | 106701808 A | 5/2017 |
| CN | 106701818 A | 5/2017 |
| CN | 106701823 A | 5/2017 |
| CN | 106701830 A | 5/2017 |
| CN | 106754912 A | 5/2017 |
| CN | 106755026 A | 5/2017 |
| CN | 106755077 A | 5/2017 |
| CN | 106755088 A | 5/2017 |
| CN | 106755091 A | 5/2017 |
| CN | 106755097 A | 5/2017 |
| CN | 106755424 A | 5/2017 |
| CN | 106801056 A | 6/2017 |
| CN | 106834323 A | 6/2017 |
| CN | 106834341 A | 6/2017 |
| CN | 106834347 A | 6/2017 |
| CN | 106845151 A | 6/2017 |
| CN | 106868008 A | 6/2017 |
| CN | 106868031 A | 6/2017 |
| CN | 106906240 A | 6/2017 |
| CN | 106906242 A | 6/2017 |
| CN | 106916820 A | 7/2017 |
| CN | 106916852 A | 7/2017 |
| CN | 106939303 A | 7/2017 |
| CN | 106947750 A | 7/2017 |
| CN | 106947780 A | 7/2017 |
| CN | 106957830 A | 7/2017 |
| CN | 106957831 A | 7/2017 |
| CN | 106957844 A | 7/2017 |
| CN | 106957855 A | 7/2017 |
| CN | 106957858 A | 7/2017 |
| CN | 106967697 A | 7/2017 |
| CN | 106967726 A | 7/2017 |
| CN | 106978428 A | 7/2017 |
| CN | 106987570 A | 7/2017 |
| CN | 106987757 A | 7/2017 |
| CN | 107012164 A | 8/2017 |
| CN | 107012174 A | 8/2017 |
| CN | 107012213 A | 8/2017 |
| CN | 107012250 A | 8/2017 |
| CN | 107022562 A | 8/2017 |
| CN | 107034188 A | 8/2017 |
| CN | 107034218 A | 8/2017 |
| CN | 107034229 A | 8/2017 |
| CN | 107043775 A | 8/2017 |
| CN | 107043779 A | 8/2017 |
| CN | 107043787 A | 8/2017 |
| CN | 107058320 A | 8/2017 |
| CN | 107058328 A | 8/2017 |
| CN | 107058358 A | 8/2017 |
| CN | 107058372 A | 8/2017 |
| CN | 107083392 A | 8/2017 |
| CN | 107099533 A | 8/2017 |
| CN | 107099850 A | 8/2017 |
| CN | 107119053 A | 9/2017 |
| CN | 107119071 A | 9/2017 |
| CN | 107129999 A | 9/2017 |
| CN | 107130000 A | 9/2017 |
| CN | 107142272 A | 9/2017 |
| CN | 107142282 A | 9/2017 |
| CN | 107177591 A | 9/2017 |
| CN | 107177595 A | 9/2017 |
| CN | 107177625 A | 9/2017 |
| CN | 107177631 A | 9/2017 |
| CN | 107190006 A | 9/2017 |
| CN | 107190008 A | 9/2017 |
| CN | 107217042 A | 9/2017 |
| CN | 107217075 A | 9/2017 |
| CN | 107227307 A | 10/2017 |
| CN | 107227352 A | 10/2017 |
| CN | 107236737 A | 10/2017 |
| CN | 107236739 A | 10/2017 |
| CN | 107236741 A | 10/2017 |
| CN | 107245502 A | 10/2017 |
| CN | 107254485 A | 10/2017 |
| CN | 107266541 A | 10/2017 |
| CN | 107267515 A | 10/2017 |
| CN | 107287245 A | 10/2017 |
| CN | 107298701 A | 10/2017 |
| CN | 107299114 A | 10/2017 |
| CN | 107304435 A | 10/2017 |
| CN | 107312785 A | 11/2017 |
| CN | 107312793 A | 11/2017 |
| CN | 107312795 A | 11/2017 |
| CN | 107312798 A | 11/2017 |
| CN | 107326042 A | 11/2017 |
| CN | 107326046 A | 11/2017 |
| CN | 107354156 A | 11/2017 |
| CN | 107354173 A | 11/2017 |
| CN | 107356793 A | 11/2017 |
| CN | 107362372 A | 11/2017 |
| CN | 107365786 A | 11/2017 |
| CN | 107365804 A | 11/2017 |
| CN | 107384894 A | 11/2017 |
| CN | 107384922 A | 11/2017 |
| CN | 107384926 A | 11/2017 |
| CN | 107400677 A | 11/2017 |
| CN | 107418974 A | 12/2017 |
| CN | 107435051 A | 12/2017 |
| CN | 107435069 A | 12/2017 |
| CN | 107446922 A | 12/2017 |
| CN | 107446923 A | 12/2017 |
| CN | 107446924 A | 12/2017 |

(56) References Cited

FOREIGN PATENT DOCUMENTS

| | | | |
|---|---|---|---|
| CN | 107446932 A | 12/2017 |
| CN | 107446951 A | 12/2017 |
| CN | 107446954 A | 12/2017 |
| CN | 107460196 A | 12/2017 |
| CN | 107474129 A | 12/2017 |
| CN | 107475300 A | 12/2017 |
| CN | 107488649 A | 12/2017 |
| CN | 107502608 A | 12/2017 |
| CN | 107502618 A | 12/2017 |
| CN | 107513531 A | 12/2017 |
| CN | 107519492 A | 12/2017 |
| CN | 107523567 A | 12/2017 |
| CN | 107523583 A | 12/2017 |
| CN | 107541525 A | 1/2018 |
| CN | 107557373 A | 1/2018 |
| CN | 107557378 A | 1/2018 |
| CN | 107557381 A | 1/2018 |
| CN | 107557390 A | 1/2018 |
| CN | 107557393 A | 1/2018 |
| CN | 107557394 A | 1/2018 |
| CN | 107557455 A | 1/2018 |
| CN | 107574179 A | 1/2018 |
| CN | 107586777 A | 1/2018 |
| CN | 107586779 A | 1/2018 |
| CN | 107604003 A | 1/2018 |
| CN | 107619829 A | 1/2018 |
| CN | 107619837 A | 1/2018 |
| CN | 107630006 A | 1/2018 |
| CN | 107630041 A | 1/2018 |
| CN | 107630042 A | 1/2018 |
| CN | 107630043 A | 1/2018 |
| CN | 107641631 A | 1/2018 |
| CN | 107653256 A | 2/2018 |
| CN | 107686848 A | 2/2018 |
| CN | 206970581 U | 2/2018 |
| CN | 107760652 A | 3/2018 |
| CN | 107760663 A | 3/2018 |
| CN | 107760684 A | 3/2018 |
| CN | 107760715 A | 3/2018 |
| CN | 107784200 A | 3/2018 |
| CN | 107794272 A | 3/2018 |
| CN | 107794276 A | 3/2018 |
| CN | 107815463 A | 3/2018 |
| CN | 107828738 A | 3/2018 |
| CN | 107828794 A | 3/2018 |
| CN | 107828826 A | 3/2018 |
| CN | 107828874 A | 3/2018 |
| CN | 107858346 A | 3/2018 |
| CN | 107858373 A | 3/2018 |
| CN | 107880132 A | 4/2018 |
| CN | 107881184 A | 4/2018 |
| CN | 107893074 A | 4/2018 |
| CN | 107893075 A | 4/2018 |
| CN | 107893076 A | 4/2018 |
| CN | 107893080 A | 4/2018 |
| CN | 107893086 A | 4/2018 |
| CN | 107904261 A | 4/2018 |
| CN | 107937427 A | 4/2018 |
| CN | 107937432 A | 4/2018 |
| CN | 107937501 A | 4/2018 |
| CN | 107974466 A | 5/2018 |
| CN | 107988229 A | 5/2018 |
| CN | 107988246 A | 5/2018 |
| CN | 107988256 A | 5/2018 |
| CN | 107988268 A | 5/2018 |
| CN | 108018316 A | 5/2018 |
| CN | 108034656 A | 5/2018 |
| CN | 108048466 A | 5/2018 |
| CN | 108102940 A | 6/2018 |
| CN | 108103090 A | 6/2018 |
| CN | 108103092 A | 6/2018 |
| CN | 108103098 A | 6/2018 |
| CN | 108103586 A | 6/2018 |
| CN | 108148835 A | 6/2018 |
| CN | 108148837 A | 6/2018 |
| CN | 108148873 A | 6/2018 |
| CN | 108192956 A | 6/2018 |
| CN | 108251423 A | 7/2018 |
| CN | 108251451 A | 7/2018 |
| CN | 108251452 A | 7/2018 |
| CN | 108342480 A | 7/2018 |
| CN | 108359691 A | 8/2018 |
| CN | 108359712 A | 8/2018 |
| CN | 108384784 A | 8/2018 |
| CN | 108396027 A | 8/2018 |
| CN | 108410877 A | 8/2018 |
| CN | 108410906 A | 8/2018 |
| CN | 108410907 A | 8/2018 |
| CN | 108410911 A | 8/2018 |
| CN | 108424931 A | 8/2018 |
| CN | 108441519 A | 8/2018 |
| CN | 108441520 A | 8/2018 |
| CN | 108486108 A | 9/2018 |
| CN | 108486111 A | 9/2018 |
| CN | 108486145 A | 9/2018 |
| CN | 108486146 A | 9/2018 |
| CN | 108486154 A | 9/2018 |
| CN | 108486159 A | 9/2018 |
| CN | 108486234 A | 9/2018 |
| CN | 108504657 A | 9/2018 |
| CN | 108504685 A | 9/2018 |
| CN | 108504693 A | 9/2018 |
| CN | 108546712 A | 9/2018 |
| CN | 108546717 A | 9/2018 |
| CN | 108546718 A | 9/2018 |
| CN | 108559730 A | 9/2018 |
| CN | 108559732 A | 9/2018 |
| CN | 108559745 A | 9/2018 |
| CN | 108559760 A | 9/2018 |
| CN | 108570479 A | 9/2018 |
| CN | 108588071 A | 9/2018 |
| CN | 108588123 A | 9/2018 |
| CN | 108588128 A | 9/2018 |
| CN | 108588182 A | 9/2018 |
| CN | 108610399 A | 10/2018 |
| CN | 108611364 A | 10/2018 |
| CN | 108624622 A | 10/2018 |
| CN | 108642053 A | 10/2018 |
| CN | 108642055 A | 10/2018 |
| CN | 108642077 A | 10/2018 |
| CN | 108642078 A | 10/2018 |
| CN | 108642090 A | 10/2018 |
| CN | 108690844 A | 10/2018 |
| CN | 108707604 A | 10/2018 |
| CN | 108707620 A | 10/2018 |
| CN | 108707621 A | 10/2018 |
| CN | 108707628 A | 10/2018 |
| CN | 108707629 A | 10/2018 |
| CN | 108715850 A | 10/2018 |
| CN | 108728476 A | 11/2018 |
| CN | 108728486 A | 11/2018 |
| CN | 108753772 A | 11/2018 |
| CN | 108753783 A | 11/2018 |
| CN | 108753813 A | 11/2018 |
| CN | 108753817 A | 11/2018 |
| CN | 108753832 A | 11/2018 |
| CN | 108753835 A | 11/2018 |
| CN | 108753836 A | 11/2018 |
| CN | 108795902 A | 11/2018 |
| CN | 108822217 A | 11/2018 |
| CN | 108823248 A | 11/2018 |
| CN | 108823249 A | 11/2018 |
| CN | 108823291 A | 11/2018 |
| CN | 108841845 A | 11/2018 |
| CN | 108853133 A | 11/2018 |
| CN | 108866093 A | 11/2018 |
| CN | 108893529 A | 11/2018 |
| CN | 108913664 A | 11/2018 |
| CN | 108913691 A | 11/2018 |
| CN | 108913714 A | 11/2018 |
| CN | 108913717 A | 11/2018 |
| CN | 208034188 U | 11/2018 |
| CN | 109 517 841 A | 3/2019 |
| EP | 0264166 A1 | 4/1988 |

(56) References Cited

FOREIGN PATENT DOCUMENTS

| | | |
|---|---|---|
| EP | 321201 B2 | 6/1989 |
| EP | 519463 A1 | 12/1992 |
| EP | 2604255 A1 | 6/2013 |
| EP | 2840140 A1 | 2/2015 |
| EP | 2877490 A2 | 6/2015 |
| EP | 2966170 A1 | 1/2016 |
| EP | 3009511 A2 | 4/2016 |
| EP | 3031921 A1 | 6/2016 |
| EP | 3045537 A1 | 7/2016 |
| EP | 3 115 457 A | 1/2017 |
| EP | 3144390 A1 | 3/2017 |
| EP | 3199632 A1 | 8/2017 |
| EP | 3216867 A1 | 9/2017 |
| EP | 3252160 A1 | 12/2017 |
| EP | 3450553 B1 | 12/2019 |
| EP | 3177726 B1 | 1/2021 |
| ES | 2740248 T3 | 2/2020 |
| GB | 2528177 A | 1/2016 |
| GB | 2 531 454 A1 | 4/2016 |
| GB | 2542653 A | 3/2017 |
| HK | 1208045 A1 | 2/2016 |
| JP | 2007-501626 A | 2/2007 |
| JP | 2008-515405 A | 5/2008 |
| JP | 2010-033344 A | 2/2010 |
| JP | 2010-535744 A | 11/2010 |
| JP | 2010-539929 A | 12/2010 |
| JP | 2011-081011 A | 4/2011 |
| JP | 2011-523353 A | 8/2011 |
| JP | 2012-525146 A | 10/2012 |
| JP | 2012-210172 A | 11/2012 |
| JP | 2012-531909 A | 12/2012 |
| JP | 2015-523856 A | 8/2015 |
| JP | 2015-532654 A | 11/2015 |
| JP | 2016-525888 A | 9/2016 |
| JP | 2016-534132 A | 11/2016 |
| JP | 2017-500035 A | 1/2017 |
| JP | 2018-521045 A | 8/2018 |
| JP | 6629734 B2 | 1/2020 |
| JP | 6633524 B2 | 1/2020 |
| KR | 101584933 B1 | 1/2016 |
| KR | 2016-0050069 A | 5/2016 |
| KR | 20160133380 A | 11/2016 |
| KR | 20170037025 A | 4/2017 |
| KR | 20170037028 A | 4/2017 |
| KR | 101748575 B1 | 6/2017 |
| KR | 20170128137 A | 11/2017 |
| KR | 2018-0022465 A | 3/2018 |
| NZ | 700688 A | 2/2016 |
| RU | 2016104674 A | 8/2017 |
| RU | 2634395 C1 | 10/2017 |
| RU | 2652899 C1 | 5/2018 |
| RU | 2015128057 A | 3/2019 |
| RU | 2015128098 A | 3/2019 |
| RU | 2687451 C1 | 5/2019 |
| RU | 2019112514 A | 6/2019 |
| RU | 2019127300 A | 9/2019 |
| RU | 2701850 C2 | 10/2019 |
| SG | 10201707569 Y | 10/2017 |
| SG | 10201710486 A | 1/2018 |
| SG | 10201710487 A | 1/2018 |
| SG | 10201710488 T | 1/2018 |
| TW | I608100 B | 12/2017 |
| TW | 2018-29773 A | 8/2018 |
| WO | WO 90/02809 | 3/1990 |
| WO | WO 1991/003162 A1 | 3/1991 |
| WO | WO 91/16024 A1 | 10/1991 |
| WO | WO 91/17271 A1 | 11/1991 |
| WO | WO 91/17424 A1 | 11/1991 |
| WO | WO 92/06188 A2 | 4/1992 |
| WO | WO 92/06200 A1 | 4/1992 |
| WO | WO 1992/007065 A1 | 4/1992 |
| WO | WO 1993/015187 A1 | 8/1993 |
| WO | WO 93/24641 A2 | 12/1993 |
| WO | WO 94/18316 A2 | 8/1994 |
| WO | WO 94/026877 A1 | 11/1994 |
| WO | WO 96/04403 A1 | 2/1996 |
| WO | WO 96/10640 A1 | 4/1996 |
| WO | WO 98/32845 A1 | 7/1998 |
| WO | WO 2001/036452 A2 | 5/2001 |
| WO | WO 2001/038547 A2 | 5/2001 |
| WO | WO 2002/059296 A2 | 8/2002 |
| WO | WO 2002/068676 A2 | 9/2002 |
| WO | WO 2002/103028 A2 | 12/2002 |
| WO | WO 2004/007684 A2 | 1/2004 |
| WO | WO 2005/014791 A2 | 2/2005 |
| WO | WO 2005/019415 A2 | 3/2005 |
| WO | WO 2006/002547 A1 | 1/2006 |
| WO | WO 2006/042112 A2 | 4/2006 |
| WO | WO 2007/025097 A2 | 3/2007 |
| WO | WO 2007/037444 A1 | 4/2007 |
| WO | WO 07/066923 A1 | 6/2007 |
| WO | WO 2007/136815 A2 | 11/2007 |
| WO | WO 2007/143574 A1 | 12/2007 |
| WO | WO 08/005529 A2 | 1/2008 |
| WO | WO 2008/108989 A2 | 9/2008 |
| WO | WO 2009/002418 A2 | 12/2008 |
| WO | WO 2009/098290 A1 | 8/2009 |
| WO | WO 2009/134808 A2 | 11/2009 |
| WO | WO 2010/011961 A2 | 1/2010 |
| WO | WO 2010/012902 A1 | 2/2010 |
| WO | WO 2010/028347 A2 | 3/2010 |
| WO | WO 2010/054108 A2 | 5/2010 |
| WO | WO 2010/054154 A2 | 5/2010 |
| WO | WO 2010/068289 A2 | 6/2010 |
| WO | WO 2010/075424 A2 | 7/2010 |
| WO | WO 2010/102257 A2 | 9/2010 |
| WO | WO 2010/104749 A2 | 9/2010 |
| WO | WO 2010/129019 A2 | 11/2010 |
| WO | WO 2010/129023 A2 | 11/2010 |
| WO | WO 2010/132092 A2 | 11/2010 |
| WO | WO 2010/144150 A2 | 12/2010 |
| WO | WO 2011/002503 A1 | 1/2011 |
| WO | WO 2011/017293 A2 | 2/2011 |
| WO | WO 2011/053868 A1 | 5/2011 |
| WO | WO 2011/053982 A2 | 5/2011 |
| WO | WO 2011/068810 A1 | 6/2011 |
| WO | WO 2011/075627 A1 | 6/2011 |
| WO | WO 2011/091311 A2 | 7/2011 |
| WO | WO 2011/091396 A1 | 7/2011 |
| WO | WO 2011/109031 A1 | 9/2011 |
| WO | WO 2011/143124 A2 | 11/2011 |
| WO | WO 2011/147590 A2 | 12/2011 |
| WO | WO 2011/159369 A1 | 12/2011 |
| WO | WO 2012/054726 A1 | 4/2012 |
| WO | WO 2012/065043 A2 | 5/2012 |
| WO | WO 2012/088381 A2 | 6/2012 |
| WO | WO 2012/125445 A2 | 9/2012 |
| WO | WO 2012/138927 A2 | 10/2012 |
| WO | WO 2012/149470 A1 | 11/2012 |
| WO | WO 2012/158985 A2 | 11/2012 |
| WO | WO 2012/158986 A2 | 11/2012 |
| WO | WO 2012/164565 A1 | 12/2012 |
| WO | WO 2012/170930 A1 | 12/2012 |
| WO | WO 2013/012674 A1 | 1/2013 |
| WO | WO 2013/013105 A1 | 1/2013 |
| WO | WO 2013/039857 A1 | 3/2013 |
| WO | WO 2013/039861 A2 | 3/2013 |
| WO | WO 2013/045632 A1 | 4/2013 |
| WO | WO 2013/047844 A1 | 4/2013 |
| WO | WO 2013/066438 A2 | 5/2013 |
| WO | WO 2013/086441 A2 | 6/2013 |
| WO | WO 2013/086444 A2 | 6/2013 |
| WO | WO 2013/098244 A1 | 7/2013 |
| WO | WO 2013/119602 A1 | 8/2013 |
| WO | WO 2013/126794 A1 | 8/2013 |
| WO | WO 2013/130824 A1 | 9/2013 |
| WO | WO 2013/141680 A1 | 9/2013 |
| WO | WO 2013/142578 A2 | 9/2013 |
| WO | WO 2013/152359 A1 | 10/2013 |
| WO | WO 2013/160230 A1 | 10/2013 |
| WO | 2013/169802 A1 | 11/2013 |
| WO | 2013/176772 A2 | 11/2013 |
| WO | 2013/176915 A1 | 11/2013 |
| WO | 2013/176916 A1 | 11/2013 |

(56) References Cited

FOREIGN PATENT DOCUMENTS

| | | |
|---|---|---|
| WO | WO 2013/166315 A1 | 11/2013 |
| WO | WO 2013/169398 A2 | 11/2013 |
| WO | 2013/181440 A1 | 12/2013 |
| WO | 2013/186754 A2 | 12/2013 |
| WO | 2013/188037 A2 | 12/2013 |
| WO | 2013/188522 A2 | 12/2013 |
| WO | 2013/188638 A2 | 12/2013 |
| WO | 2013/192278 A1 | 12/2013 |
| WO | 2013/142378 A9 | 1/2014 |
| WO | 2014/004336 A2 | 1/2014 |
| WO | 2014/005042 A2 | 1/2014 |
| WO | 2014/011237 A1 | 1/2014 |
| WO | 2014/011901 A2 | 1/2014 |
| WO | 2014/018423 A2 | 1/2014 |
| WO | 2014/020608 A1 | 2/2014 |
| WO | 2014/022120 A1 | 2/2014 |
| WO | 2014/022702 A2 | 2/2014 |
| WO | 2014/036219 A2 | 3/2014 |
| WO | 2014/039513 A2 | 3/2014 |
| WO | 2014/039523 A1 | 3/2014 |
| WO | 2014/039585 A2 | 3/2014 |
| WO | 2014/039684 A1 | 3/2014 |
| WO | 2014/039692 A2 | 3/2014 |
| WO | 2014/039702 A2 | 3/2014 |
| WO | 2014/039872 A1 | 3/2014 |
| WO | WO 2014/039970 A1 | 3/2014 |
| WO | WO 2014/041327 A1 | 3/2014 |
| WO | WO 2014/043143 A1 | 3/2014 |
| WO | WO 2014/047103 A2 | 3/2014 |
| WO | WO 2014/055782 A1 | 4/2014 |
| WO | WO 2014/059173 A2 | 4/2014 |
| WO | WO 2014/059255 A1 | 4/2014 |
| WO | WO 2014/065596 A1 | 5/2014 |
| WO | WO 2014/066505 A1 | 5/2014 |
| WO | WO 2014/068346 A2 | 5/2014 |
| WO | WO 2014/070887 A1 | 5/2014 |
| WO | WO 2014/071006 A1 | 5/2014 |
| WO | WO 2014/071219 A1 | 5/2014 |
| WO | WO 2014/071235 A1 | 5/2014 |
| WO | WO 2014/072941 A1 | 5/2014 |
| WO | WO 2014/081729 A1 | 5/2014 |
| WO | WO 2014/081730 A1 | 5/2014 |
| WO | WO 2014/081855 A1 | 5/2014 |
| WO | WO 2014/082644 A1 | 6/2014 |
| WO | WO 2014/085261 A1 | 6/2014 |
| WO | WO 2014/085593 A1 | 6/2014 |
| WO | WO 2014/085830 A2 | 6/2014 |
| WO | WO 2014/089212 A1 | 6/2014 |
| WO | WO 2014/089290 A1 | 6/2014 |
| WO | WO 2014/089348 A1 | 6/2014 |
| WO | WO 2014/089513 A1 | 6/2014 |
| WO | WO 2014/089533 A2 | 6/2014 |
| WO | WO 2014/089541 A2 | 6/2014 |
| WO | WO 2014/093479 A1 | 6/2014 |
| WO | WO 2014/093595 A1 | 6/2014 |
| WO | WO 2014/093622 A2 | 6/2014 |
| WO | WO 2014/093635 A1 | 6/2014 |
| WO | WO 2014/093655 A2 | 6/2014 |
| WO | WO 2014/093661 A2 | 6/2014 |
| WO | WO 2014/093694 A1 | 6/2014 |
| WO | WO 2014/093701 A1 | 6/2014 |
| WO | WO 2014/093709 A1 | 6/2014 |
| WO | WO 2014/093712 A1 | 6/2014 |
| WO | WO 2014/093718 A1 | 6/2014 |
| WO | WO 2014/093736 A1 | 6/2014 |
| WO | WO 2014/093768 A1 | 6/2014 |
| WO | WO 2014/093852 A1 | 6/2014 |
| WO | WO 2014/096972 A2 | 6/2014 |
| WO | WO 2014/099744 A1 | 6/2014 |
| WO | WO 2014/099750 A2 | 6/2014 |
| WO | WO 2014/104878 A1 | 7/2014 |
| WO | WO 2014/110006 A1 | 7/2014 |
| WO | WO 2014/110552 A1 | 7/2014 |
| WO | WO 2014/113493 A1 | 7/2014 |
| WO | WO 2014/123967 A2 | 8/2014 |
| WO | WO 2014/124226 A1 | 8/2014 |
| WO | WO 2014/125668 A1 | 8/2014 |
| WO | WO 2014/127287 A1 | 8/2014 |
| WO | WO 2014/128324 A1 | 8/2014 |
| WO | WO 2014/128659 A1 | 8/2014 |
| WO | WO 2014/130706 A1 | 8/2014 |
| WO | WO 2014/130955 A1 | 8/2014 |
| WO | WO 2014/131833 A1 | 9/2014 |
| WO | WO 2014/138379 A1 | 9/2014 |
| WO | WO 2014/143381 A1 | 9/2014 |
| WO | WO 2014/144094 A1 | 9/2014 |
| WO | WO 2014/144155 A1 | 9/2014 |
| WO | WO 2014/144288 A1 | 9/2014 |
| WO | WO 2014/144592 A2 | 9/2014 |
| WO | WO 2014/144761 A2 | 9/2014 |
| WO | WO 2014/144951 A1 | 9/2014 |
| WO | WO 2014/145599 A2 | 9/2014 |
| WO | WO 2014/145736 A2 | 9/2014 |
| WO | WO 2014/150624 A1 | 9/2014 |
| WO | WO 2014/152432 A2 | 9/2014 |
| WO | WO 2014/152940 A1 | 9/2014 |
| WO | WO 2014/153118 A1 | 9/2014 |
| WO | WO 2014/153470 A2 | 9/2014 |
| WO | WO 2014/158593 A1 | 10/2014 |
| WO | WO 2014/161821 A1 | 10/2014 |
| WO | WO 2014/164466 A1 | 10/2014 |
| WO | WO 2014/165177 A1 | 10/2014 |
| WO | WO 2014/165349 A1 | 10/2014 |
| WO | WO 2014/165612 A2 | 10/2014 |
| WO | WO 2014/165707 A2 | 10/2014 |
| WO | WO 2014/165825 A2 | 10/2014 |
| WO | WO 2014/172458 A1 | 10/2014 |
| WO | WO 2014/172470 A2 | 10/2014 |
| WO | WO 2014/172489 A2 | 10/2014 |
| WO | WO 2014/173955 A1 | 10/2014 |
| WO | WO 2014/182700 A1 | 11/2014 |
| WO | WO 2014/183071 A2 | 11/2014 |
| WO | WO 2014/184143 A1 | 11/2014 |
| WO | WO 2014/184741 A1 | 11/2014 |
| WO | WO 2014/184744 A1 | 11/2014 |
| WO | WO 2014/186585 A2 | 11/2014 |
| WO | WO 2014/186686 A2 | 11/2014 |
| WO | WO 2014/190181 A1 | 11/2014 |
| WO | WO 2014/191128 A1 | 12/2014 |
| WO | WO 2014/191518 A1 | 12/2014 |
| WO | WO 2014/191521 A2 | 12/2014 |
| WO | WO 2014/191525 A1 | 12/2014 |
| WO | WO 2014/191527 A1 | 12/2014 |
| WO | WO 2014/193583 A2 | 12/2014 |
| WO | WO 2014/194190 A1 | 12/2014 |
| WO | WO 2014/197568 A2 | 12/2014 |
| WO | WO 2014/197748 A2 | 12/2014 |
| WO | WO 2014/199358 A1 | 12/2014 |
| WO | WO 2014/200659 A1 | 12/2014 |
| WO | WO 2014/201015 A2 | 12/2014 |
| WO | WO 2014/204578 A1 | 12/2014 |
| WO | WO 2014/204723 A1 | 12/2014 |
| WO | WO 2014/204724 A1 | 12/2014 |
| WO | WO 2014/204725 A1 | 12/2014 |
| WO | WO 2014/204726 A1 | 12/2014 |
| WO | WO 2014/204727 A1 | 12/2014 |
| WO | WO 2014/204728 A1 | 12/2014 |
| WO | WO 2014/204729 A1 | 12/2014 |
| WO | WO 2014/205192 A2 | 12/2014 |
| WO | WO 2014/207043 A1 | 12/2014 |
| WO | WO 2015/002780 A1 | 1/2015 |
| WO | WO 2015/004241 A2 | 1/2015 |
| WO | WO 2015/006290 A1 | 1/2015 |
| WO | WO 2015/006294 A2 | 1/2015 |
| WO | WO 2015/006437 A1 | 1/2015 |
| WO | WO 2015/006498 A2 | 1/2015 |
| WO | WO 2015/006747 A1 | 1/2015 |
| WO | WO 2015/007194 A1 | 1/2015 |
| WO | WO 2015/010114 A1 | 1/2015 |
| WO | WO 2015/011483 A1 | 1/2015 |
| WO | WO 2015/013583 A2 | 1/2015 |
| WO | WO 2015/017866 A1 | 2/2015 |
| WO | WO 2015/018503 A1 | 2/2015 |
| WO | WO 2015/021353 A1 | 2/2015 |

(56) References Cited

FOREIGN PATENT DOCUMENTS

| | | |
|---|---|---|
| WO | WO 2015/021426 A1 | 2/2015 |
| WO | WO 2015/021990 A1 | 2/2015 |
| WO | WO 2015/024017 A2 | 2/2015 |
| WO | WO 2015/024986 A1 | 2/2015 |
| WO | WO 2015/026883 A1 | 2/2015 |
| WO | WO 2015/026885 A1 | 2/2015 |
| WO | WO 2015/026886 A1 | 2/2015 |
| WO | WO 2015/026887 A1 | 2/2015 |
| WO | WO 2015/027134 A1 | 2/2015 |
| WO | WO 2015/028969 A2 | 3/2015 |
| WO | WO 2015/030881 A1 | 3/2015 |
| WO | WO 2015/031619 A1 | 3/2015 |
| WO | WO 2015/031775 A1 | 3/2015 |
| WO | WO 2015/032494 A2 | 3/2015 |
| WO | WO 2015/033293 A1 | 3/2015 |
| WO | WO 2015/034872 A2 | 3/2015 |
| WO | WO 2015/034885 A1 | 3/2015 |
| WO | WO 2015/035136 A2 | 3/2015 |
| WO | WO 2015/035139 A2 | 3/2015 |
| WO | WO 2015/035162 A2 | 3/2015 |
| WO | WO 2015/040075 A1 | 3/2015 |
| WO | WO 2015/040402 A1 | 3/2015 |
| WO | WO 2015/042393 A2 | 3/2015 |
| WO | WO 2015/042585 A1 | 3/2015 |
| WO | WO 2015/048577 A2 | 4/2015 |
| WO | WO 2015/048690 A1 | 4/2015 |
| WO | WO 2015/048707 A2 | 4/2015 |
| WO | WO 2015/048801 A2 | 4/2015 |
| WO | WO 2015/049897 A1 | 4/2015 |
| WO | WO 2015/051191 A1 | 4/2015 |
| WO | WO 2015/052133 A1 | 4/2015 |
| WO | WO 2015/052231 A2 | 4/2015 |
| WO | WO 2015/052335 A1 | 4/2015 |
| WO | WO 2015/053995 A1 | 4/2015 |
| WO | WO 2015/054253 A1 | 4/2015 |
| WO | WO 2015/054315 A1 | 4/2015 |
| WO | WO 2015/057671 A1 | 4/2015 |
| WO | WO 2015/057834 A1 | 4/2015 |
| WO | WO 2015/057852 A1 | 4/2015 |
| WO | WO 2015/057976 A1 | 4/2015 |
| WO | WO 2015/057980 A1 | 4/2015 |
| WO | WO 2015/059265 A1 | 4/2015 |
| WO | WO 2015/065964 A1 | 5/2015 |
| WO | WO 2015/066119 A1 | 5/2015 |
| WO | WO 2015/066634 A2 | 5/2015 |
| WO | WO 2015/066636 A2 | 5/2015 |
| WO | WO 2015/066637 A1 | 5/2015 |
| WO | WO 2015/066638 A2 | 5/2015 |
| WO | WO 2015/066643 A1 | 5/2015 |
| WO | WO 2015/069682 A2 | 5/2015 |
| WO | WO 2015/070083 A1 | 5/2015 |
| WO | WO 2015/070193 A1 | 5/2015 |
| WO | WO 2015/070212 A1 | 5/2015 |
| WO | WO 2015/071474 A2 | 5/2015 |
| WO | WO 2015/073683 A2 | 5/2015 |
| WO | WO 2015/073867 A1 | 5/2015 |
| WO | WO 2015/073990 A1 | 5/2015 |
| WO | WO 2015/075056 A1 | 5/2015 |
| WO | WO 2015/075154 A2 | 5/2015 |
| WO | WO 2015/075175 A1 | 5/2015 |
| WO | WO 2015/075195 A1 | 5/2015 |
| WO | WO 2015/075557 A2 | 5/2015 |
| WO | WO 2015/077058 A2 | 5/2015 |
| WO | WO 2015/077290 A2 | 5/2015 |
| WO | WO 2015/077318 A1 | 5/2015 |
| WO | WO 2015/079056 A1 | 6/2015 |
| WO | WO 2015/079057 A2 | 6/2015 |
| WO | WO 2015/086795 A1 | 6/2015 |
| WO | WO 2015/086798 A2 | 6/2015 |
| WO | WO 2015/088643 A1 | 6/2015 |
| WO | WO 2015/089046 A1 | 6/2015 |
| WO | WO 2015/089077 A2 | 6/2015 |
| WO | WO 2015/089277 A1 | 6/2015 |
| WO | WO 2015/089351 A1 | 6/2015 |
| WO | WO 2015/089354 A1 | 6/2015 |
| WO | WO 2015/089364 A1 | 6/2015 |
| WO | WO 2015/089406 A1 | 6/2015 |
| WO | WO 2015/089419 A2 | 6/2015 |
| WO | WO 2015/089427 A1 | 6/2015 |
| WO | WO 2015/089462 A1 | 6/2015 |
| WO | WO 2015/089465 A1 | 6/2015 |
| WO | WO 2015/089473 A1 | 6/2015 |
| WO | WO 2015/089486 A1 | 6/2015 |
| WO | WO 2015/089486 A2 | 6/2015 |
| WO | WO 2015/095804 A1 | 6/2015 |
| WO | WO 2015/099850 A1 | 7/2015 |
| WO | WO 2015/100929 A1 | 7/2015 |
| WO | WO 2015/103057 A1 | 7/2015 |
| WO | WO 2015/103153 A1 | 7/2015 |
| WO | WO 2015/105928 A1 | 7/2015 |
| WO | WO 2015/108993 A1 | 7/2015 |
| WO | WO 2015/109752 A1 | 7/2015 |
| WO | WO 2015/110474 A1 | 7/2015 |
| WO | WO 2015/112790 A2 | 7/2015 |
| WO | WO 2015/112896 A2 | 7/2015 |
| WO | WO 2015/113063 A1 | 7/2015 |
| WO | WO 2015/114365 A1 | 8/2015 |
| WO | WO 2015/115903 A1 | 8/2015 |
| WO | WO 2015/116686 A1 | 8/2015 |
| WO | WO 2015/116969 A2 | 8/2015 |
| WO | WO 2015/117021 A1 | 8/2015 |
| WO | WO 2015/117041 A1 | 8/2015 |
| WO | WO 2015/117081 A2 | 8/2015 |
| WO | WO 2015/118156 A1 | 8/2015 |
| WO | WO 2015/119941 A2 | 8/2015 |
| WO | WO 2015/121454 A1 | 8/2015 |
| WO | WO 2015/122967 A1 | 8/2015 |
| WO | WO 2015/123339 A1 | 8/2015 |
| WO | WO 2015/124715 A1 | 8/2015 |
| WO | WO 2015/124718 A1 | 8/2015 |
| WO | WO 2015/126927 A2 | 8/2015 |
| WO | WO 2015/127428 A1 | 8/2015 |
| WO | WO 2015/127439 A1 | 8/2015 |
| WO | WO 2015/129686 A1 | 9/2015 |
| WO | WO 2015/131101 A1 | 9/2015 |
| WO | WO 2015/133554 A1 | 9/2015 |
| WO | WO 2015/134121 A2 | 9/2015 |
| WO | WO 2015/134812 A1 | 9/2015 |
| WO | WO 2015/136001 A1 | 9/2015 |
| WO | WO 2015/138510 A1 | 9/2015 |
| WO | WO 2015/138739 A2 | 9/2015 |
| WO | WO 2015/138855 A1 | 9/2015 |
| WO | WO 2015/138870 A2 | 9/2015 |
| WO | WO 2015/139008 A1 | 9/2015 |
| WO | WO 2015/139139 A1 | 9/2015 |
| WO | WO 2015/143046 A2 | 9/2015 |
| WO | WO 2015/143177 A1 | 9/2015 |
| WO | WO 2015/145417 A1 | 10/2015 |
| WO | WO 2015/148431 A1 | 10/2015 |
| WO | WO 2015/148670 A1 | 10/2015 |
| WO | WO 2015/148680 A1 | 10/2015 |
| WO | WO 2015/148761 A1 | 10/2015 |
| WO | WO 2015/148860 A1 | 10/2015 |
| WO | WO 2015/148863 A2 | 10/2015 |
| WO | WO 2015/153760 A2 | 10/2015 |
| WO | WO 2015/153780 A1 | 10/2015 |
| WO | WO 2015/153789 A1 | 10/2015 |
| WO | WO 2015/153791 A1 | 10/2015 |
| WO | WO 2015/153889 A2 | 10/2015 |
| WO | WO 2015/153940 A1 | 10/2015 |
| WO | WO 2015/155341 A1 | 10/2015 |
| WO | WO 2015/155686 A2 | 10/2015 |
| WO | WO 2015/157070 A2 | 10/2015 |
| WO | WO 2015/157534 A1 | 10/2015 |
| WO | WO 2015/159068 A1 | 10/2015 |
| WO | WO 2015/159086 A1 | 10/2015 |
| WO | WO 2015/159087 A1 | 10/2015 |
| WO | WO 2015/160683 A1 | 10/2015 |
| WO | WO 2015/161276 A2 | 10/2015 |
| WO | WO 2015/163733 A1 | 10/2015 |
| WO | WO 2015/164740 A1 | 10/2015 |
| WO | WO 2015/164748 A1 | 10/2015 |
| WO | WO 2015/165274 A1 | 11/2015 |
| WO | WO 2015/165275 A1 | 11/2015 |

(56) References Cited

FOREIGN PATENT DOCUMENTS

| | | |
|---|---|---|
| WO | WO 2015/165276 A1 | 11/2015 |
| WO | WO 2015/166272 A2 | 11/2015 |
| WO | WO 2015/167766 A1 | 11/2015 |
| WO | WO 2015/167956 A1 | 11/2015 |
| WO | WO 2015/168125 A1 | 11/2015 |
| WO | WO 2015/168158 A1 | 11/2015 |
| WO | WO 2015/168404 A1 | 11/2015 |
| WO | WO 2015/168547 A2 | 11/2015 |
| WO | WO 2015/168800 A1 | 11/2015 |
| WO | WO 2015/171603 A1 | 11/2015 |
| WO | WO 2015/171894 A1 | 11/2015 |
| WO | WO 2015/171932 A1 | 11/2015 |
| WO | WO 2015/172128 A1 | 11/2015 |
| WO | WO 2015/173436 A1 | 11/2015 |
| WO | WO 2015/175642 A2 | 11/2015 |
| WO | WO 2015/179540 A1 | 11/2015 |
| WO | WO 2015/183025 A1 | 12/2015 |
| WO | WO 2015/183026 A1 | 12/2015 |
| WO | WO 2015/183885 A1 | 12/2015 |
| WO | WO 2015/184259 A1 | 12/2015 |
| WO | WO 2015/184262 A1 | 12/2015 |
| WO | WO 2015/184268 A1 | 12/2015 |
| WO | WO 2015/188056 A1 | 12/2015 |
| WO | WO 2015/188065 A1 | 12/2015 |
| WO | WO 2015/188094 A1 | 12/2015 |
| WO | WO 2015/188109 A1 | 12/2015 |
| WO | WO 2015/188132 A1 | 12/2015 |
| WO | WO 2015/188135 A1 | 12/2015 |
| WO | WO 2015/188191 A1 | 12/2015 |
| WO | WO 2015/189693 A1 | 12/2015 |
| WO | WO 2015/191693 A2 | 12/2015 |
| WO | WO 2015/191899 A1 | 12/2015 |
| WO | WO 2015/191911 A2 | 12/2015 |
| WO | WO 2015/193858 A1 | 12/2015 |
| WO | WO 2015/195547 A1 | 12/2015 |
| WO | WO 2015/195621 A1 | 12/2015 |
| WO | WO 2015/195798 A1 | 12/2015 |
| WO | WO 2015/198020 A1 | 12/2015 |
| WO | WO 2015/200334 A1 | 12/2015 |
| WO | WO 2015/200378 A1 | 12/2015 |
| WO | WO 2015/200555 A2 | 12/2015 |
| WO | WO 2015/200805 A2 | 12/2015 |
| WO | WO 2016/001978 A1 | 1/2016 |
| WO | WO 2016/004010 A1 | 1/2016 |
| WO | WO 2016/004318 A1 | 1/2016 |
| WO | WO 2016/007347 A1 | 1/2016 |
| WO | WO 2016/007604 A1 | 1/2016 |
| WO | WO 2016/007948 A1 | 1/2016 |
| WO | WO 2016/011080 A2 | 1/2016 |
| WO | WO 2016/011210 A2 | 1/2016 |
| WO | WO 2016/011428 A1 | 1/2016 |
| WO | WO 2016/012544 A2 | 1/2016 |
| WO | WO 2016/012552 A1 | 1/2016 |
| WO | WO 2016/014409 A1 | 1/2016 |
| WO | WO 2016/014565 A2 | 1/2016 |
| WO | WO 2016/014794 A1 | 1/2016 |
| WO | WO 2016/014837 A1 | 1/2016 |
| WO | WO 2016/016119 A1 | 2/2016 |
| WO | WO 2016/016358 A1 | 2/2016 |
| WO | WO 2016/019144 A2 | 2/2016 |
| WO | WO 2016/020399 A1 | 2/2016 |
| WO | WO 2016/021972 A1 | 2/2016 |
| WO | WO 2016/021973 A1 | 2/2016 |
| WO | WO 2016/022363 A2 | 2/2016 |
| WO | WO 2016/022866 A1 | 2/2016 |
| WO | WO 2016/022931 A1 | 2/2016 |
| WO | WO 2016/025131 A1 | 2/2016 |
| WO | WO 2016/025469 A1 | 2/2016 |
| WO | WO 2016/025759 A1 | 2/2016 |
| WO | WO 2016/026444 A1 | 2/2016 |
| WO | WO 2016/028682 A1 | 2/2016 |
| WO | WO 2016/028843 A2 | 2/2016 |
| WO | WO 2016/028887 A1 | 2/2016 |
| WO | WO 2016/033088 A1 | 3/2016 |
| WO | WO 2016/033230 A1 | 3/2016 |
| WO | WO 2016/033246 A1 | 3/2016 |
| WO | WO 2016/033298 A1 | 3/2016 |
| WO | WO 2016/035044 A1 | 3/2016 |
| WO | WO 2016/036754 A1 | 3/2016 |
| WO | WO 2016/037157 A2 | 3/2016 |
| WO | WO 2016/040030 A1 | 3/2016 |
| WO | WO 2016/040594 A1 | 3/2016 |
| WO | WO 2016/044182 A1 | 3/2016 |
| WO | WO 2016/044416 A1 | 3/2016 |
| WO | WO 2016/046635 A1 | 3/2016 |
| WO | WO 2016/049024 A2 | 3/2016 |
| WO | WO 2016/049163 A2 | 3/2016 |
| WO | WO 2016/049230 A1 | 3/2016 |
| WO | WO 2016/049251 A1 | 3/2016 |
| WO | WO 2016/049258 A2 | 3/2016 |
| WO | WO 2016/053397 A2 | 4/2016 |
| WO | WO 2016/054326 A1 | 4/2016 |
| WO | WO 2016/057061 A2 | 4/2016 |
| WO | WO 2016/057821 A2 | 4/2016 |
| WO | WO 2016/057835 A2 | 4/2016 |
| WO | WO 2016/057850 A1 | 4/2016 |
| WO | WO 2016/057951 A2 | 4/2016 |
| WO | WO 2016/057961 A1 | 4/2016 |
| WO | WO 2016/061073 A1 | 4/2016 |
| WO | WO 2016/061374 A1 | 4/2016 |
| WO | WO 2016/061481 A1 | 4/2016 |
| WO | WO 2016/061523 A1 | 4/2016 |
| WO | WO 2016/064894 A2 | 4/2016 |
| WO | WO 2016/065364 A1 | 4/2016 |
| WO | WO 2016/069282 A1 | 5/2016 |
| WO | WO 2016/069283 A1 | 5/2016 |
| WO | WO 2016/069591 A2 | 5/2016 |
| WO | WO 2016/069774 A1 | 5/2016 |
| WO | WO 2016/069910 A1 | 5/2016 |
| WO | WO 2016/069912 A1 | 5/2016 |
| WO | WO 2016/070037 A2 | 5/2016 |
| WO | WO 2016/070070 A1 | 5/2016 |
| WO | WO 2016/070129 A1 | 5/2016 |
| WO | WO 2016/072399 A1 | 5/2016 |
| WO | WO 2016/072936 A1 | 5/2016 |
| WO | WO 2016/073433 A1 | 5/2016 |
| WO | WO 2016/073559 A1 | 5/2016 |
| WO | WO 2016/073990 A2 | 5/2016 |
| WO | WO 2016/075662 A1 | 5/2016 |
| WO | WO 2016/076672 A1 | 5/2016 |
| WO | WO 2016/077273 A1 | 5/2016 |
| WO | WO 2016/077350 A1 | 5/2016 |
| WO | WO 2016/080097 A1 | 5/2016 |
| WO | WO 2016/080795 A1 | 5/2016 |
| WO | WO 2016/081923 A2 | 5/2016 |
| WO | WO 2016/081924 A1 | 5/2016 |
| WO | WO 2016/082135 A1 | 6/2016 |
| WO | WO 2016/083811 A1 | 6/2016 |
| WO | WO 2016/084084 A1 | 6/2016 |
| WO | WO 2016/084088 A1 | 6/2016 |
| WO | WO 2016/086177 A2 | 6/2016 |
| WO | WO 2016/089433 A1 | 6/2016 |
| WO | WO 2016/089866 A1 | 6/2016 |
| WO | WO 2016/089883 A1 | 6/2016 |
| WO | WO 2016/090385 A1 | 6/2016 |
| WO | WO 2016/094679 A1 | 6/2016 |
| WO | WO 2016/094845 A2 | 6/2016 |
| WO | WO 2016/094867 A1 | 6/2016 |
| WO | WO 2016/094872 A1 | 6/2016 |
| WO | WO 2016/094874 A1 | 6/2016 |
| WO | WO 2016/094880 A1 | 6/2016 |
| WO | WO 2016/094888 A1 | 6/2016 |
| WO | WO 2016/097212 A1 | 6/2016 |
| WO | WO 2016/097231 A2 | 6/2016 |
| WO | WO 2016/097751 A1 | 6/2016 |
| WO | WO 2016/099887 A1 | 6/2016 |
| WO | WO 2016/100272 A1 | 6/2016 |
| WO | WO 2016/100389 A1 | 6/2016 |
| WO | WO 2016/100568 A1 | 6/2016 |
| WO | WO 2016/100571 A1 | 6/2016 |
| WO | WO 2016/100951 A2 | 6/2016 |
| WO | WO 2016/100955 A2 | 6/2016 |
| WO | WO 2016/100974 A1 | 6/2016 |
| WO | WO 2016/103233 A2 | 6/2016 |

(56) References Cited

FOREIGN PATENT DOCUMENTS

| | | |
|---|---|---|
| WO | WO 2016/104716 A1 | 6/2016 |
| WO | WO 2016/106236 A1 | 6/2016 |
| WO | WO 2016/106239 A1 | 6/2016 |
| WO | WO 2016/106244 A1 | 6/2016 |
| WO | WO 2016/106338 A2 | 6/2016 |
| WO | WO 2016/108926 A1 | 7/2016 |
| WO | WO 2016/109255 A1 | 7/2016 |
| WO | WO 2016/109840 A2 | 7/2016 |
| WO | WO 2016/110214 A1 | 7/2016 |
| WO | WO 2016/110453 A1 | 7/2016 |
| WO | WO 2016/110511 A1 | 7/2016 |
| WO | WO 2016/110512 A1 | 7/2016 |
| WO | WO 2016/111546 A2 | 7/2016 |
| WO | WO 2016/112242 A1 | 7/2016 |
| WO | WO 2016/112351 A1 | 7/2016 |
| WO | WO 2016/112963 A1 | 7/2016 |
| WO | WO 2016/113357 A1 | 7/2016 |
| WO | WO 2016/114972 A1 | 7/2016 |
| WO | WO 2016/115179 A1 | 7/2016 |
| WO | WO 2016/115326 A1 | 7/2016 |
| WO | WO 2016/115355 A1 | 7/2016 |
| WO | WO 2016/116032 A1 | 7/2016 |
| WO | WO 2016/120480 A1 | 8/2016 |
| WO | WO 2016/123071 A1 | 8/2016 |
| WO | WO 2016/123230 A1 | 8/2016 |
| WO | WO 2016/123243 A1 | 8/2016 |
| WO | WO 2016/123578 A1 | 8/2016 |
| WO | WO 2016/126747 A1 | 8/2016 |
| WO | WO 2016/130600 A2 | 8/2016 |
| WO | WO 2016/130697 A1 | 8/2016 |
| WO | WO 2016/131009 A1 | 8/2016 |
| WO | WO 2016/132122 A1 | 8/2016 |
| WO | WO 2016/133165 A1 | 8/2016 |
| WO | WO 2016/135507 A1 | 9/2016 |
| WO | WO 2016/135557 A2 | 9/2016 |
| WO | WO 2016/135558 A2 | 9/2016 |
| WO | WO 2016/135559 A2 | 9/2016 |
| WO | WO 2016/137774 A1 | 9/2016 |
| WO | WO 2016/137949 A1 | 9/2016 |
| WO | WO 2016/141224 A1 | 9/2016 |
| WO | WO 2016/141893 A1 | 9/2016 |
| WO | WO 2016/142719 A1 | 9/2016 |
| WO | WO 2016/145150 A2 | 9/2016 |
| WO | WO 2016/148994 A1 | 9/2016 |
| WO | WO 2016/149484 A2 | 9/2016 |
| WO | WO 2016/149547 A1 | 9/2016 |
| WO | WO 2016/150336 A1 | 9/2016 |
| WO | WO 2016/150855 A1 | 9/2016 |
| WO | WO 2016/154016 A2 | 9/2016 |
| WO | WO 2016/154579 A2 | 9/2016 |
| WO | WO 2016/154596 A1 | 9/2016 |
| WO | WO 2016/155482 A1 | 10/2016 |
| WO | WO 2016/161004 A1 | 10/2016 |
| WO | WO 2016/161207 A1 | 10/2016 |
| WO | WO 2016/161260 A1 | 10/2016 |
| WO | WO 2016/161380 A1 | 10/2016 |
| WO | WO 2016/161446 A1 | 10/2016 |
| WO | WO 2016/164356 A1 | 10/2016 |
| WO | WO 2016/164797 A1 | 10/2016 |
| WO | WO 2016/166340 A1 | 10/2016 |
| WO | WO 2016/167300 A1 | 10/2016 |
| WO | WO 2016/168631 A1 | 10/2016 |
| WO | WO 2016/170484 A1 | 10/2016 |
| WO | WO 2016/172359 A2 | 10/2016 |
| WO | WO 2016/172727 A1 | 10/2016 |
| WO | WO 2016/174056 A1 | 11/2016 |
| WO | WO 2016/174151 A1 | 11/2016 |
| WO | WO 2016/174250 A1 | 11/2016 |
| WO | WO 2016/176191 A1 | 11/2016 |
| WO | WO 2016/176404 A1 | 11/2016 |
| WO | WO 2016/176690 A2 | 11/2016 |
| WO | WO 2016/177682 A1 | 11/2016 |
| WO | WO 2016/178207 A1 | 11/2016 |
| WO | WO 2016/179038 A1 | 11/2016 |
| WO | WO 2016/179112 A1 | 11/2016 |
| WO | WO 2016/181357 A1 | 11/2016 |
| WO | WO 2016/182893 A1 | 11/2016 |
| WO | WO 2016/182917 A1 | 11/2016 |
| WO | WO 2016/182959 A1 | 11/2016 |
| WO | WO 2016/183236 A1 | 11/2016 |
| WO | WO 2016/183298 A2 | 11/2016 |
| WO | WO 2016/183345 A1 | 11/2016 |
| WO | WO 2016/183402 A2 | 11/2016 |
| WO | WO 2016/183438 A1 | 11/2016 |
| WO | WO 2016/183448 A1 | 11/2016 |
| WO | WO 2016/184955 A2 | 11/2016 |
| WO | WO 2016/184989 A1 | 11/2016 |
| WO | WO 2016/185411 A1 | 11/2016 |
| WO | WO 2016/186745 A1 | 11/2016 |
| WO | WO 2016/186772 A2 | 11/2016 |
| WO | WO 2016/186946 A1 | 11/2016 |
| WO | WO 2016/186953 A1 | 11/2016 |
| WO | WO 2016/187717 A1 | 12/2016 |
| WO | WO 2016/187904 A1 | 12/2016 |
| WO | WO 2016/191684 A1 | 12/2016 |
| WO | WO 2016/191869 A1 | 12/2016 |
| WO | WO 2016/196273 A1 | 12/2016 |
| WO | WO 2016/196282 A1 | 12/2016 |
| WO | WO 2016/196308 A1 | 12/2016 |
| WO | WO 2016/196361 A1 | 12/2016 |
| WO | WO 2016/196499 A1 | 12/2016 |
| WO | WO 2016/196539 A2 | 12/2016 |
| WO | WO 2016/196655 A1 | 12/2016 |
| WO | WO 2016/196805 A1 | 12/2016 |
| WO | WO 2016/196887 A1 | 12/2016 |
| WO | WO 2016/197132 A1 | 12/2016 |
| WO | WO 2016/197133 A1 | 12/2016 |
| WO | WO 2016/197354 A1 | 12/2016 |
| WO | WO 2016/197355 A1 | 12/2016 |
| WO | WO 2016/197356 A1 | 12/2016 |
| WO | WO 2016/197357 A1 | 12/2016 |
| WO | WO 2016/197358 A1 | 12/2016 |
| WO | WO 2016/197359 A1 | 12/2016 |
| WO | WO 2016/197360 A1 | 12/2016 |
| WO | WO 2016/197361 A1 | 12/2016 |
| WO | WO 2016/197362 A1 | 12/2016 |
| WO | WO 2016/198361 A1 | 12/2016 |
| WO | WO 2016/198500 A1 | 12/2016 |
| WO | WO 2016/200263 A1 | 12/2016 |
| WO | WO 2016/201047 A1 | 12/2016 |
| WO | WO 2016/201138 A1 | 12/2016 |
| WO | WO 2016/201152 A1 | 12/2016 |
| WO | WO 2016/201153 A1 | 12/2016 |
| WO | WO 2016/201155 A1 | 12/2016 |
| WO | WO 2016/205276 A1 | 12/2016 |
| WO | WO 2016/205613 A1 | 12/2016 |
| WO | WO 2016/205623 A1 | 12/2016 |
| WO | WO 2016/205680 A1 | 12/2016 |
| WO | WO 2016/205688 A2 | 12/2016 |
| WO | WO 2016/205703 A1 | 12/2016 |
| WO | WO 2016/205711 A1 | 12/2016 |
| WO | WO 2016/205728 A1 | 12/2016 |
| WO | WO 2016/205745 A2 | 12/2016 |
| WO | WO 2016/205749 A1 | 12/2016 |
| WO | WO 2016/205759 A1 | 12/2016 |
| WO | WO 2016/205764 A1 | 12/2016 |
| WO | WO 2017/001572 A1 | 1/2017 |
| WO | WO 2017/001988 A1 | 1/2017 |
| WO | WO 2017/004261 A1 | 1/2017 |
| WO | WO 2017/004279 A2 | 1/2017 |
| WO | WO 2017/004616 A1 | 1/2017 |
| WO | WO 2017/005807 A1 | 1/2017 |
| WO | WO 2017/009399 A1 | 1/2017 |
| WO | WO 2017/010556 A1 | 1/2017 |
| WO | WO 2017/011519 A1 | 1/2017 |
| WO | WO 2017/011721 A1 | 1/2017 |
| WO | WO 2017/011804 A1 | 1/2017 |
| WO | WO 2017/015015 A1 | 1/2017 |
| WO | WO 2017/015101 A1 | 1/2017 |
| WO | WO 2017/015545 A1 | 1/2017 |
| WO | WO 2017/015567 A1 | 1/2017 |
| WO | WO 2017/015637 A1 | 1/2017 |
| WO | WO 2017/017016 A1 | 2/2017 |
| WO | WO 2017/019867 A1 | 2/2017 |

(56) References Cited

FOREIGN PATENT DOCUMENTS

| | | |
|---|---|---|
| WO | WO 2017/019895 A1 | 2/2017 |
| WO | WO 2017/023803 A1 | 2/2017 |
| WO | WO 2017/023974 A1 | 2/2017 |
| WO | WO 2017/024047 A1 | 2/2017 |
| WO | WO 2017/024319 A1 | 2/2017 |
| WO | WO 2017/024343 A1 | 2/2017 |
| WO | WO 2017/024602 A1 | 2/2017 |
| WO | WO 2017/025323 A1 | 2/2017 |
| WO | WO 2017/027423 A1 | 2/2017 |
| WO | WO 2017/028768 A1 | 2/2017 |
| WO | WO 2017/029664 A1 | 2/2017 |
| WO | WO 2017/031360 A1 | 2/2017 |
| WO | WO 2017/031483 A1 | 2/2017 |
| WO | WO 2017/035416 A2 | 3/2017 |
| WO | WO 2017/040348 A1 | 3/2017 |
| WO | WO 2017/040511 A1 | 3/2017 |
| WO | WO 2017/040709 A1 | 3/2017 |
| WO | WO 2017/040786 A1 | 3/2017 |
| WO | WO 2017/040793 A1 | 3/2017 |
| WO | WO 2017/040813 A2 | 3/2017 |
| WO | WO 2017/043573 A1 | 3/2017 |
| WO | WO 2017/043656 A1 | 3/2017 |
| WO | WO 2017/044419 A1 | 3/2017 |
| WO | WO 2017/044776 A1 | 3/2017 |
| WO | WO 2017/044857 A2 | 3/2017 |
| WO | WO 2017/048390 A1 | 3/2017 |
| WO | WO 2017/049129 A2 | 3/2017 |
| WO | WO 2017/050963 A1 | 3/2017 |
| WO | WO 2017/053312 A1 | 3/2017 |
| WO | WO 2017/053431 A2 | 3/2017 |
| WO | WO 2017/053713 A1 | 3/2017 |
| WO | WO 2017/053729 A1 | 3/2017 |
| WO | WO 2017/053753 A1 | 3/2017 |
| WO | WO 2017/053762 A1 | 3/2017 |
| WO | WO 2017/053879 A1 | 3/2017 |
| WO | WO 2017/054721 A1 | 4/2017 |
| WO | WO 2017/058658 A2 | 4/2017 |
| WO | WO 2017/059241 A1 | 4/2017 |
| WO | WO 2017/062605 A1 | 4/2017 |
| WO | WO 2017/062723 A1 | 4/2017 |
| WO | WO 2017/062754 A1 | 4/2017 |
| WO | WO 2017/062855 A1 | 4/2017 |
| WO | WO 2017/062886 A1 | 4/2017 |
| WO | WO 2017/062983 A1 | 4/2017 |
| WO | WO 2017/064439 A1 | 4/2017 |
| WO | WO 2017/064546 A1 | 4/2017 |
| WO | WO 2017/064566 A2 | 4/2017 |
| WO | WO 2017/066175 A1 | 4/2017 |
| WO | WO 2017/066497 A2 | 4/2017 |
| WO | WO 2017/066588 A2 | 4/2017 |
| WO | WO 2017/066707 A1 | 4/2017 |
| WO | WO 2017/066781 A1 | 4/2017 |
| WO | WO 2017/068077 A1 | 4/2017 |
| WO | WO 2017/068377 A1 | 4/2017 |
| WO | WO 2017/069829 A2 | 4/2017 |
| WO | WO 2017/070029 A1 | 4/2017 |
| WO | WO 2017/070032 A1 | 4/2017 |
| WO | WO 2017/070169 A1 | 4/2017 |
| WO | WO 2017/070284 A1 | 4/2017 |
| WO | WO 2017/070598 A1 | 4/2017 |
| WO | WO 2017/070605 A1 | 4/2017 |
| WO | WO 2017/070632 A2 | 4/2017 |
| WO | WO 2017/070633 A2 | 4/2017 |
| WO | WO 2017/072590 A1 | 5/2017 |
| WO | WO 2017/074526 A1 | 5/2017 |
| WO | WO 2017/074962 A1 | 5/2017 |
| WO | WO 2017/075261 A1 | 5/2017 |
| WO | WO 2017/075335 A1 | 5/2017 |
| WO | WO 2017/075475 A1 | 5/2017 |
| WO | WO 2017/077135 A1 | 5/2017 |
| WO | WO 2017/077329 A2 | 5/2017 |
| WO | WO 2017/078751 A1 | 5/2017 |
| WO | WO 2017/079400 A1 | 5/2017 |
| WO | WO 2017/079428 A1 | 5/2017 |
| WO | WO 2017/079673 A1 | 5/2017 |
| WO | WO 2017/079724 A1 | 5/2017 |
| WO | WO 2017/081097 A1 | 5/2017 |
| WO | WO 2017/081288 A1 | 5/2017 |
| WO | WO 2017/083368 A1 | 5/2017 |
| WO | WO 2017/083722 A1 | 5/2017 |
| WO | WO 2017/083766 A1 | 5/2017 |
| WO | WO 2017/087395 A1 | 5/2017 |
| WO | WO 2017/090724 A1 | 6/2017 |
| WO | WO 2017/091510 A1 | 6/2017 |
| WO | WO 2017/091630 A1 | 6/2017 |
| WO | WO 2017/092201 A1 | 6/2017 |
| WO | WO 2017/093370 A1 | 6/2017 |
| WO | WO 2017/093969 A1 | 6/2017 |
| WO | WO 2017/095111 A1 | 6/2017 |
| WO | WO 2017/096041 A1 | 6/2017 |
| WO | WO 2017/096237 A1 | 6/2017 |
| WO | WO 2017/100158 A1 | 6/2017 |
| WO | WO 2017/100431 A2 | 6/2017 |
| WO | WO 2017/104404 A1 | 6/2017 |
| WO | WO 2017/105251 A1 | 6/2017 |
| WO | WO 2017/105350 A1 | 6/2017 |
| WO | WO 2017/105991 A1 | 6/2017 |
| WO | WO 2017/106414 A1 | 6/2017 |
| WO | WO 2017/106528 A2 | 6/2017 |
| WO | WO 2017/106537 A2 | 6/2017 |
| WO | WO 2017/106569 A1 | 6/2017 |
| WO | WO 2017/106616 A1 | 6/2017 |
| WO | WO 2017/106657 A1 | 6/2017 |
| WO | WO 2017/106767 A1 | 6/2017 |
| WO | WO 2017/109134 A1 | 6/2017 |
| WO | WO 2017/109757 A1 | 6/2017 |
| WO | WO 2017/112620 A1 | 6/2017 |
| WO | WO 2017/115268 A1 | 7/2017 |
| WO | WO 2017/117395 A1 | 7/2017 |
| WO | WO 2017/118598 A1 | 7/2017 |
| WO | WO 2017/118720 A1 | 7/2017 |
| WO | WO 2017/123609 A1 | 7/2017 |
| WO | WO 2017/123910 A1 | 7/2017 |
| WO | WO 2017/124086 A1 | 7/2017 |
| WO | WO 2017/124100 A1 | 7/2017 |
| WO | WO 2017/124652 A1 | 7/2017 |
| WO | WO 2017/126987 A1 | 7/2017 |
| WO | WO 2017/127807 A1 | 7/2017 |
| WO | WO 2017/131237 A1 | 8/2017 |
| WO | WO 2017/132112 A1 | 8/2017 |
| WO | WO 2017/132580 A2 | 8/2017 |
| WO | WO 2017/136520 A1 | 8/2017 |
| WO | WO 2017/136629 A1 | 8/2017 |
| WO | WO 2017/136794 A1 | 8/2017 |
| WO | WO 2017/139264 A1 | 8/2017 |
| WO | WO 2017/139505 A2 | 8/2017 |
| WO | WO 2017/141173 A2 | 8/2017 |
| WO | WO 2017/142835 A1 | 8/2017 |
| WO | WO 2017/142923 A1 | 8/2017 |
| WO | WO 2017/142999 A2 | 8/2017 |
| WO | WO 2017/143042 A2 | 8/2017 |
| WO | WO 2017/147056 A1 | 8/2017 |
| WO | WO 2017/147278 A1 | 8/2017 |
| WO | WO 2017/147432 A1 | 8/2017 |
| WO | WO 2017/147446 A1 | 8/2017 |
| WO | WO 2017/147555 A1 | 8/2017 |
| WO | WO 2017/151444 A1 | 9/2017 |
| WO | WO 2017/151719 A1 | 9/2017 |
| WO | WO 2017/152015 A1 | 9/2017 |
| WO | WO 2017/155717 A1 | 9/2017 |
| WO | WO 2017/157422 A1 | 9/2017 |
| WO | WO 2017/158153 A1 | 9/2017 |
| WO | WO 2017/160689 A1 | 9/2017 |
| WO | WO 2017/160752 A1 | 9/2017 |
| WO | WO 2017/160890 A1 | 9/2017 |
| WO | WO 2017/161068 A1 | 9/2017 |
| WO | WO 2017/165826 A1 | 9/2017 |
| WO | WO 2017/165862 A1 | 9/2017 |
| WO | WO 2017/167712 A1 | 10/2017 |
| WO | WO 2017/172644 A2 | 10/2017 |
| WO | WO 2017/172645 A2 | 10/2017 |
| WO | WO 2017/172860 A1 | 10/2017 |
| WO | WO 2017/173004 A1 | 10/2017 |
| WO | WO 2017/173054 A1 | 10/2017 |

(56) References Cited

FOREIGN PATENT DOCUMENTS

| | | |
|---|---|---|
| WO | WO 2017/173092 A1 | 10/2017 |
| WO | WO 2017/174329 A1 | 10/2017 |
| WO | WO 2017/176529 A1 | 10/2017 |
| WO | WO 2017/176806 A1 | 10/2017 |
| WO | WO 2017/178590 A1 | 10/2017 |
| WO | WO 2017/180694 A1 | 10/2017 |
| WO | WO 2017/180711 A1 | 10/2017 |
| WO | WO 2017/180915 A2 | 10/2017 |
| WO | WO 2017/180926 A1 | 10/2017 |
| WO | WO 2017/181107 A2 | 10/2017 |
| WO | WO 2017/181735 A2 | 10/2017 |
| WO | WO 2017/182468 A1 | 10/2017 |
| WO | WO 2017/184334 A1 | 10/2017 |
| WO | WO 2017/184768 A1 | 10/2017 |
| WO | WO 2017/184786 A1 | 10/2017 |
| WO | WO 2017/186550 A1 | 11/2017 |
| WO | WO 2017/189308 A1 | 11/2017 |
| WO | WO 2017/189336 A1 | 11/2017 |
| WO | WO 2017/190041 A1 | 11/2017 |
| WO | WO 2017/190257 A1 | 11/2017 |
| WO | WO 2017/190664 A1 | 11/2017 |
| WO | WO 2017/191210 A1 | 11/2017 |
| WO | WO 2017/191274 A2 | 11/2017 |
| WO | WO 2017/192172 A1 | 11/2017 |
| WO | WO 2017/192512 A2 | 11/2017 |
| WO | WO 2017/192544 A1 | 11/2017 |
| WO | WO 2017/192573 A1 | 11/2017 |
| WO | WO 2017/193029 A2 | 11/2017 |
| WO | WO 2017/193053 A1 | 11/2017 |
| WO | WO 2017/196768 A1 | 11/2017 |
| WO | WO 2017/197038 A1 | 11/2017 |
| WO | WO 2017/197238 A1 | 11/2017 |
| WO | WO 2017/197301 A1 | 11/2017 |
| WO | WO 2017/201476 A1 | 11/2017 |
| WO | WO 2017/205290 A1 | 11/2017 |
| WO | WO 2017/205423 A1 | 11/2017 |
| WO | WO 2017/207589 A1 | 12/2017 |
| WO | WO 2017/208247 A1 | 12/2017 |
| WO | WO 2017/209809 A1 | 12/2017 |
| WO | WO 2017/213896 A1 | 12/2017 |
| WO | WO 2017/213898 A2 | 12/2017 |
| WO | WO 2017/214460 A1 | 12/2017 |
| WO | WO 2017/216392 A1 | 12/2017 |
| WO | WO 2017/216771 A2 | 12/2017 |
| WO | WO 2017/218185 A1 | 12/2017 |
| WO | WO 2017/219027 A1 | 12/2017 |
| WO | WO 2017/219033 A1 | 12/2017 |
| WO | WO 2017/220751 A1 | 12/2017 |
| WO | WO 2017/222370 A1 | 12/2017 |
| WO | WO 2017/222773 A1 | 12/2017 |
| WO | WO 2017/222834 A1 | 12/2017 |
| WO | WO 2017/223107 A1 | 12/2017 |
| WO | WO 2017/223330 A1 | 12/2017 |
| WO | WO 2018/000657 A1 | 1/2018 |
| WO | WO 2018/002719 A1 | 1/2018 |
| WO | WO 2018/005117 A1 | 1/2018 |
| WO | WO 2018/005289 A2 | 1/2018 |
| WO | WO 2018/005691 A1 | 1/2018 |
| WO | WO 2018/005782 A1 | 1/2018 |
| WO | WO 2018/005873 A1 | 1/2018 |
| WO | WO 2018/06693 A1 | 1/2018 |
| WO | WO 2018/009520 A1 | 1/2018 |
| WO | WO 2018/009562 A1 | 1/2018 |
| WO | WO 2018/009822 A1 | 1/2018 |
| WO | WO 2018/013821 A1 | 1/2018 |
| WO | WO 2018/013932 A1 | 1/2018 |
| WO | WO 2018/013990 A1 | 1/2018 |
| WO | WO 2018/014384 A1 | 1/2018 |
| WO | WO 2018/015444 A1 | 1/2018 |
| WO | WO 2018/015936 A2 | 1/2018 |
| WO | WO 2018/017754 A1 | 1/2018 |
| WO | WO 2018/018979 A1 | 2/2018 |
| WO | WO 2018/020248 A1 | 2/2018 |
| WO | WO 2018/021878 A1 | 2/2018 |
| WO | WO 2018/022480 A1 | 2/2018 |
| WO | WO 2018/022634 A1 | 2/2018 |
| WO | WO 2018/025206 A1 | 2/2018 |
| WO | WO 2018/026723 A1 | 2/2018 |
| WO | WO 2018/026976 A1 | 2/2018 |
| WO | WO 2018/027078 A1 | 2/2018 |
| WO | WO 2018/030608 A1 | 2/2018 |
| WO | WO 2018/031683 A1 | 2/2018 |
| WO | WO 2018/035250 A1 | 2/2018 |
| WO | WO 2018/035300 A1 | 2/2018 |
| WO | WO 2018/035423 A1 | 2/2018 |
| WO | WO 2018/035503 A1 | 2/2018 |
| WO | WO 2018/039145 A1 | 3/2018 |
| WO | WO 2018/039438 A1 | 3/2018 |
| WO | WO 2018/039440 A1 | 3/2018 |
| WO | WO 2018/039448 A1 | 3/2018 |
| WO | WO 2018/045630 A1 | 3/2018 |
| WO | WO 2018/048827 A1 | 3/2018 |
| WO | WO 2018/049073 A1 | 3/2018 |
| WO | WO 2018/049168 A1 | 3/2018 |
| WO | WO 2018/051347 A1 | 3/2018 |
| WO | WO 2018/058064 A1 | 3/2018 |
| WO | WO 2018/062866 A2 | 4/2018 |
| WO | WO 2018/064352 A1 | 4/2018 |
| WO | WO 2018/064371 A1 | 4/2018 |
| WO | WO 2018/064516 A1 | 4/2018 |
| WO | WO 2018/067546 A1 | 4/2018 |
| WO | WO 2018/067846 A1 | 4/2018 |
| WO | WO 2018/068053 A2 | 4/2018 |
| WO | WO 2018/069474 A1 | 4/2018 |
| WO | WO 2018/071623 A2 | 4/2018 |
| WO | WO 2018/071663 A1 | 4/2018 |
| WO | WO 2018/071868 A1 | 4/2018 |
| WO | WO 2018/071892 A1 | 4/2018 |
| WO | WO 2018/074979 A1 | 4/2018 |
| WO | WO 2018/079134 A1 | 5/2018 |
| WO | WO 2018/080573 A1 | 5/2018 |
| WO | WO 2018/081504 A1 | 5/2018 |
| WO | WO 2018/081535 A2 | 5/2018 |
| WO | WO 2018/081728 A1 | 5/2018 |
| WO | WO 2018/083128 A2 | 5/2018 |
| WO | WO 2018/083606 A1 | 5/2018 |
| WO | WO 2018/085288 A1 | 5/2018 |
| WO | WO 2018/085414 A1 | 5/2018 |
| WO | WO 2018/086623 A1 | 5/2018 |
| WO | WO 2018/089664 A1 | 5/2018 |
| WO | WO 2018/093990 A1 | 5/2018 |
| WO | WO 2018/098383 A1 | 5/2018 |
| WO | WO 2018/098480 A1 | 5/2018 |
| WO | WO 2018/098587 A1 | 6/2018 |
| WO | WO 2018/099256 A1 | 6/2018 |
| WO | WO 2018/103686 A1 | 6/2018 |
| WO | WO 2018/106268 A1 | 6/2018 |
| WO | WO 2018/107028 A1 | 6/2018 |
| WO | WO 2018/107103 A1 | 6/2018 |
| WO | WO 2018/107129 A1 | 6/2018 |
| WO | WO 2018/108272 A1 | 6/2018 |
| WO | WO 2018/109101 A1 | 6/2018 |
| WO | WO 2018/111946 A1 | 6/2018 |
| WO | WO 2018/111947 A1 | 6/2018 |
| WO | WO 2018/112336 A1 | 6/2018 |
| WO | WO 2018/112446 A2 | 6/2018 |
| WO | WO 2018/119354 A1 | 6/2018 |
| WO | WO 2018/119359 A1 | 6/2018 |
| WO | WO 2018/120283 A1 | 7/2018 |
| WO | WO 2018/130830 A1 | 7/2018 |
| WO | WO 2018/135838 A1 | 7/2018 |
| WO | WO 2018/136396 A2 | 7/2018 |
| WO | WO 2018/138385 A1 | 8/2018 |
| WO | WO 2018/142364 A1 | 8/2018 |
| WO | WO 2018/148246 A1 | 8/2018 |
| WO | WO 2018/148256 A1 | 8/2018 |
| WO | WO 2018/148647 A2 | 8/2018 |
| WO | WO 2018/149418 A1 | 8/2018 |
| WO | WO 2018/149888 A1 | 8/2018 |
| WO | WO 2018/149915 A1 | 8/2018 |
| WO | WO 2018/152197 A1 | 8/2018 |
| WO | WO 2018/152418 A1 | 8/2018 |
| WO | WO 2018/154380 A1 | 8/2018 |
| WO | WO 2018/154387 A1 | 8/2018 |

(56) References Cited

FOREIGN PATENT DOCUMENTS

| | | |
|---|---|---|
| WO | WO 2018/154412 A1 | 8/2018 |
| WO | WO 2018/154413 A1 | 8/2018 |
| WO | WO 2018/154418 A1 | 8/2018 |
| WO | WO 2018/154439 A1 | 8/2018 |
| WO | WO 2018/154459 A1 | 8/2018 |
| WO | WO 2018/154462 A1 | 8/2018 |
| WO | WO 2018/156372 A1 | 8/2018 |
| WO | WO 2018/156824 A1 | 8/2018 |
| WO | WO 2018/161009 A1 | 9/2018 |
| WO | WO 2018/165504 A1 | 9/2018 |
| WO | WO 2018/165629 A1 | 9/2018 |
| WO | WO 2018/170015 A1 | 9/2018 |
| WO | WO 2018/170340 A1 | 9/2018 |
| WO | WO 2018/175502 A2 | 9/2018 |
| WO | WO 2018/176009 A1 | 9/2018 |
| WO | WO 2018/177351 A1 | 10/2018 |
| WO | WO 2018/179578 A1 | 10/2018 |
| WO | WO 2018/183403 A1 | 10/2018 |
| WO | WO 2018/189184 A1 | 10/2018 |
| WO | WO 2018/191388 A1 | 10/2018 |
| WO | WO 2018/195402 A1 | 10/2018 |
| WO | WO 2018/195545 A2 | 10/2018 |
| WO | WO 2018/195555 A1 | 10/2018 |
| WO | WO 2018/197020 A1 | 11/2018 |
| WO | WO 2018/197495 A1 | 11/2018 |
| WO | WO 2018/202800 A1 | 11/2018 |
| WO | WO 2018/204493 A1 | 11/2018 |
| WO | WO 2018/208755 A1 | 11/2018 |
| WO | WO 2018/208998 A1 | 11/2018 |
| WO | WO 2018/209158 A2 | 11/2018 |
| WO | WO 2018/209320 A1 | 11/2018 |
| WO | WO 2018/213351 A1 | 11/2018 |
| WO | WO 2018/213708 A1 | 11/2018 |
| WO | WO 2018/213726 A1 | 11/2018 |
| WO | WO 2018/213771 A1 | 11/2018 |
| WO | WO 2018/213791 A1 | 11/2018 |
| WO | WO 2018/217852 A1 | 11/2018 |
| WO | WO 2018/217981 A1 | 11/2018 |
| WO | WO 2018/218166 A1 | 11/2018 |
| WO | WO 2018/218188 A2 | 11/2018 |
| WO | WO 2018/218206 A1 | 11/2018 |
| WO | WO 2018/226855 A1 | 12/2018 |
| WO | WO 2019/005884 A1 | 1/2019 |
| WO | WO 2019/005886 A1 | 1/2019 |
| WO | WO 2019/010384 A1 | 1/2019 |
| WO | WO 2019/023680 A1 | 1/2019 |
| WO | WO 2019/042284 A1 | 3/2019 |
| WO | WO 2019/051097 A1 | 3/2019 |
| WO | WO 2019/075357 A1 | 4/2019 |
| WO | WO 2019/079347 A1 | 4/2019 |
| WO | WO 2019/084062 A1 | 5/2019 |
| WO | WO 2019/090367 A1 | 5/2019 |
| WO | WO 2019/092042 A1 | 5/2019 |
| WO | WO 2019/118935 A1 | 6/2019 |
| WO | WO 2019/118949 A1 | 6/2019 |
| WO | WO 2019/123430 A1 | 6/2019 |
| WO | WO 2019/139645 A2 | 7/2019 |
| WO | WO 2019/139951 A1 | 7/2019 |
| WO | WO 2019/147014 A1 | 8/2019 |
| WO | WO 2019/161251 A1 | 8/2019 |
| WO | WO 2019/168953 A1 | 9/2019 |
| WO | WO 2019/183641 A1 | 9/2019 |
| WO | WO 2019/204369 A1 | 10/2019 |
| WO | WO 2019/217942 A1 | 11/2019 |
| WO | WO 2019/226593 A1 | 11/2019 |
| WO | WO 2019/226953 A1 | 11/2019 |
| WO | WO 2019/236566 A1 | 12/2019 |
| WO | WO 2019/241649 A1 | 12/2019 |
| WO | WO 2020/014261 A1 | 1/2020 |
| WO | WO 2020/028555 A2 | 2/2020 |
| WO | WO 2020/028823 A1 | 2/2020 |
| WO | WO 2020/041751 A1 | 2/2020 |
| WO | WO 2020/047124 A1 | 3/2020 |
| WO | WO 2020/051360 A1 | 3/2020 |
| WO | WO 2020/081568 A1 | 4/2020 |
| WO | WO 2020/086908 A1 | 4/2020 |
| WO | WO 2020/092453 A1 | 5/2020 |
| WO | WO 2020/102659 A1 | 5/2020 |
| WO | WO 2020/102709 A1 | 5/2020 |
| WO | WO 2020/154500 A1 | 7/2020 |
| WO | WO 2020/157008 A1 | 8/2020 |
| WO | WO 2020/160071 A1 | 8/2020 |
| WO | WO 2020/160517 A1 | 8/2020 |
| WO | WO 2020/180975 A1 | 9/2020 |
| WO | WO 2020/181178 A1 | 9/2020 |
| WO | WO 2020/181180 A1 | 9/2020 |
| WO | WO 2020/181193 A1 | 9/2020 |
| WO | WO 2020/181195 A1 | 9/2020 |
| WO | WO 2020/181202 A1 | 9/2020 |
| WO | WO 2020/191153 A1 | 9/2020 |
| WO | WO 2020/191171 A1 | 9/2020 |
| WO | WO 2020/191233 A1 | 9/2020 |
| WO | WO 2020/191234 A1 | 9/2020 |
| WO | WO 2020/191239 A1 | 9/2020 |
| WO | WO 2020/191241 A1 | 9/2020 |
| WO | WO 2020/191242 A1 | 9/2020 |
| WO | WO 2020/191243 A1 | 9/2020 |
| WO | WO 2020/191245 A1 | 9/2020 |
| WO | WO 2020/191246 A1 | 9/2020 |
| WO | WO 2020/191248 A1 | 9/2020 |
| WO | WO 2020/191249 A1 | 9/2020 |
| WO | WO 2020/210751 A1 | 10/2020 |
| WO | WO 2020/214842 A1 | 10/2020 |
| WO | WO 2020/236982 A1 | 11/2020 |
| WO | WO 2020/247587 A1 | 12/2020 |
| WO | WO 2021/022043 A2 | 2/2021 |
| WO | WO 2021/025750 A1 | 2/2021 |
| WO | WO 2021/030344 A1 | 2/2021 |
| WO | WO 2021/030666 A1 | 2/2021 |
| WO | WO 2021/042047 A1 | 3/2021 |
| WO | WO 2021/042062 A2 | 3/2021 |
| WO | WO 2021/072328 A1 | 4/2021 |
| WO | WO 2021/080922 A1 | 4/2021 |
| WO | WO 2021/081264 A1 | 4/2021 |
| WO | WO 2021/087182 A1 | 5/2021 |
| WO | WO 2021/108717 A2 | 6/2021 |
| WO | WO 2021/138469 A1 | 7/2021 |
| WO | WO 2021/155065 A1 | 8/2021 |
| WO | WO 2021/158921 A2 | 8/2021 |
| WO | WO 2021/158995 A1 | 8/2021 |
| WO | WO 2021/158999 A1 | 8/2021 |
| WO | WO 2021/222318 A1 | 11/2021 |
| WO | WO 2021/226558 A1 | 11/2021 |
| WO | WO 2022/067130 A2 | 3/2022 |

OTHER PUBLICATIONS

U.S. Appl. No. 62/357,332, filed Jun. 30, 2016, Liu et al.
U.S. Appl. No. 62/288,661, filed Jan. 29, 2016, Muir et al.
International Preliminary Report on Patentability for PCT/US2019/033848, mailed Dec. 3, 2020.
International Search Report and Written Opinion for PCT/US2019/033848, mailed Jul. 31, 2019.
[No Author Listed] "FokI" from New England Biolabs Inc. Last accessed online via https://www.neb.com/products/r0109-foki#Product%20Information on Mar. 19, 2021. 1 page.
[No Author Listed] "Human genome." Encyclopedia Britannica. Encyclopedia Brittanica, Inc. Published Feb. 15, 2019. Last accessed online via https://www.britannica.com/science/human-genome on Mar. 19, 2021. 2 pages.
[No Author Listed] "Nucleic Acids Sizes and Molecular Weights." Printed Mar. 19, 2021. 2 pages.
[No Author Listed] "Zinc Finger Nuclease" from Wikipedia. Retrieved from https://en.wikipedia.org/w/index.php?title=Zinc_finger_nuclease&oldid=1007053318. Page last edited Feb. 16, 2021. Printed on Mar. 19, 2021.
[No Author Listed] Beast2: Bayesian evolutionary analysis by sampling trees. http://www.beast2.org/ Last accessed Apr. 28, 2021.
[No Author Listed] HyPhy—Hypothesis testing using Phylogenies. Last modified Apr. 21, 2017. Accessed online via http://hyphy.org/w/index.php/Main_Page on Apr. 28, 2021.

(56) References Cited

OTHER PUBLICATIONS

[No Author Listed] NCBI Accession No. XP_015843220.1. C->U editing enzyme APOBEC-1 [Peromyscus maniculatus bairdii], XP002793540.
[No Author Listed] NCBI Accession No. XP_021505673.1. C->U editing enzyme APOBEC-1 [Meriones unguiculatus], XP002793541.
[No Author Listed] Score result for SEQ 355 to W02017032580. Muir et al. 2016.
[No Author Listed] Theoretical Biochemistry Group. Institute for Theoretical Chemistry. The ViennaRNA Package. Universitat Wien. https://www.tbi.univie.ac.at/RNA/. Last accessed Apr. 28, 2021.
[No Author Listed], EMBL Accession No. Q99ZW2. Nov. 2012. 2 pages.
[No Author Listed], Invitrogen Lipofectamine™ 2000 product sheets, 2002. 2 pages.
[No Author Listed], Invitrogen Lipofectamine™ 2000 product sheets, 2005. 3 pages.
[No Author Listed], Invitrogen Lipofectamine™ LTX product sheets, 2011. 4 pages.
[No Author Listed], Thermo Fisher Scientific—How Cationic Lipid Mediated Transfection Works, retrieved from the internet Aug. 27, 2015. 2 pages.
Abremski et al., Bacteriophage P1 site-specific recombination. Purification and properties of the Cre recombinase protein. J Biol Chem. Feb. 10, 1984;259(3):1509-14.
Abudayyeh et al., C2c2 is a single-component programmable RNA-guided RNA-targeting CRISPR effector. Science Aug. 2016;353(6299):aaf5573. DOI: 10.1126/science.aaf5573.
Abudayyeh et al., RNA targeting with CRISPR-Cas13. Nature. Oct. 12, 2017;550(7675):280-284. doi: 10.1038/nature24049. Epub Oct. 4, 2017.
Ada et al., Carbohydrate-protein conjugate vaccines. Clin Microbiol Infect. Feb. 2003;9(2):79-85. doi: 10.1046/j.1469-0691.2003.00530.x.
Adamala et al., Programmable RNA-binding protein composed of repeats of a single modular unit. Proc Natl Acad Sci U S A. May 10, 2016;113(19):E2579-88. doi: 10.1073/pnas.1519368113. Epub Apr. 26, 2016.
Addgene Plasmid # 44246. pdCas9-humanized, 2017, Stanley Qi.
Addgene Plasmid # 73021. PCMV-BE3, 2017, David Liu.
Addgene Plasmid # 79620. pcDNA3.1_pCMV-nCas-PmCDA1-ugi pH1-gRNA(HPRT), 2017, Akihiko Kondo.
Adli, The CRISPR tool kit for genome editing and beyond. Nat Commun. May 15, 2018;9(1):1911. doi: 10.1038/s41467-018-04252-2.
Aguilo et al., Coordination of m(6)A mRNA Methylation and Gene Transcription by ZFP217 Regulates Pluripotency and Reprogramming. Cell Stem Cell. Dec. 3, 2015;17(6):689-704. doi: 10.1016/j.stem.2015.09.005. Epub Oct. 29, 2015.
Ahmad et al., Antibody-mediated specific binding and cytotoxicity of liposome-entrapped doxorubicin to lung cancer cells in vitro. Cancer Res. Sep. 1, 1992;52(17):4817-20.
Aihara et al., A conformational switch controls the DNA cleavage activity of lambda integrase. Mol Cell. Jul. 2003; 12(1):187-98.
Aik et al., Structure of human RNA N?-methyladenine demethylase ALKBH5 provides insights into its mechanisms of nucleic acid recognition and demethylation. Nucleic Acids Res. Apr. 2014;42(7):4741-54. doi: 10.1093/nar/gku085. Epub Jan. 30, 2014.
Akinsheye et al., Fetal hemoglobin in sickle cell anemia. Blood. Jul. 7, 2011;118(1):19-27. doi: 10.1182/blood-2011-03-325258. Epub Apr. 13, 2011.
Alarcón et al., HNRNPA2B1 Is a Mediator of m(6)A-Dependent Nuclear RNA Processing Events. Cell. Sep. 10, 2015;162(6):1299-308. doi: 10.1016/j.cell.2015.08.011. Epub Aug. 27, 2015.
Alarcón et al., N6-methyladenosine marks primary microRNAs for processing. Nature. Mar. 26, 2015;519(7544):482-5. doi: 10.1038/nature14281. Epub Mar. 18, 2015.
Alexander, HFE-associated hereditary hemochromatosis. Genet Med. May 2009;11(5):307-13. doi: 10.1097/GIM.0b013e31819d30f2.

Alexandrov et al., Signatures of mutational processes in human cancer. Nature. Aug. 22, 2013;500(7463):415-21. doi: 10.1038/nature12477. Epub Aug. 14, 2013.
Altschul et al., Basic local alignment search tool. J Mol Biol. Oct. 5, 1990;215(3):403-10. doi: 10.1016/S0022-2836(05)80360-2.
Amato et al., Interpreting elevated fetal hemoglobin in pathology and health at the basic laboratory level: new and known ?-gene mutations associated with hereditary persistence of fetal hemoglobin. Int J Lab Hematol. Feb. 2014;36(1):13-9. doi: 10.1111/ijlh.12094. Epub Apr. 29, 2013.
Ames et al., A eubacterial riboswitch class that senses the coenzyme tetrahydrofolate. Chem Biol. Jul. 30, 2010;17(7):681-5. doi: 10.1016/j.chembiol.2010.05.020.
Anders et al., Structural basis of PAM-dependent target DNA recognition by the Cas9 endonuclease. Nature. Sep. 25, 2014;513(7519):569-73. doi: 10.1038/nature13579. Epub Jul. 27, 2014.
Anzalone et al., Reprogramming eukaryotic translation with ligand-responsive synthetic RNA switches. Nat Methods. May 2016;13(5):453-8. doi: 10.1038/nmeth.3807. Epub Mar. 21, 2016.
Anzalone et al., Search-and-replace genome editing without double-strand breaks or donor DNA. Nature. Dec. 2019;576(7785):149-157. doi: 10.1038/s41586-019-1711-4. Epub Oct. 21, 2019.
Aplan, Causes of oncogenic chromosomal translocation. Trends Genet. Jan. 2006;22(1):46-55. doi: 10.1016/j.tig.2005.10.002. Epub Oct. 28, 2005.
Arakawa et al., A method to convert mRNA into a gRNA library for CRISPR/Cas9 editing of any organism. Sci Adv. Aug. 24, 2016;2(8):e1600699. doi: 10.1126/sciadv.1600699.
Araki et al., Comparative analysis of right element mutant lox sites on recombination efficiency in embryonic stem cells. BMC Biotechnol. Mar. 31, 2010;10:29. doi: 10.1186/1472-6750-10-29.
Araki et al., Targeted integration of DNA using mutant lox sites in embryonic stem cells. Nucleic Acids Res. Feb. 15, 1997;25(4):868-72. doi: 10.1093/nar/25.4.868.
Arambula et al., Surface display of a massively variable lipoprotein by a Legionella diversity-generating retroelement. Proc Natl Acad Sci U S A. May 14, 2013;110(20):8212-7. doi: 10.1073/pnas.1301366110. Epub Apr. 30, 2013.
Arazoe et al., Targeted Nucleotide Editing Technologies for Microbial Metabolic Engineering. Biotechnol J. Sep. 2018;13(9):e1700596. doi: 10.1002/biot.201700596. Epub Jun. 19, 2018.
Arbab et al., Cloning-free CRISPR. Stem Cell Reports. Nov. 10, 2015;5(5):908-917. doi: 10.1016/j.stemcr.2015.09.022. Epub Oct. 29, 2015.
Arezi et al., Novel mutations in Moloney Murine Leukemia Virus reverse transcriptase increase thermostability through tighter binding to template-primer. Nucleic Acids Res. Feb. 2009;37(2):473-81. doi: 10.1093/nar/gkn952. Epub Dec. 4, 2008.
Arnold et al., Mutants of Tn3 resolvase which do not require accessory binding sites for recombination activity. EMBO J. Mar. 1, 1999;18(5):1407-14.
Asante et al., A naturally occurring variant of the human prion protein completely prevents prion disease. Nature. Jun. 25, 2015;522(7557):478-81. doi: 10.1038/nature14510. Epub Jun. 10, 2015.
Atkins et al., Ribosomal frameshifting and transcriptional slippage: From genetic steganography and cryptography to adventitious use. Nucleic Acids Res. Sep. 6, 2016;44(15):7007-78. doi: 10.1093/nar/gkw530. Epub Jul. 19, 2016.
Autieri et al., IRT-1, a novel interferon-gamma-responsive transcript encoding a growth-suppressing basic leucine zipper protein. J Biol Chem. Jun. 12, 1998;273(24):14731-7. doi: 10.1074/jbc.273.24.14731.
Avidan et al., The processivity and fidelity of DNA synthesis exhibited by the reverse transcriptase of bovine leukemia virus. Eur J Biochem. Feb. 2002;269(3):859-67. doi: 10.1046/j.0014-2956.2001.02719.x.
Babacic et al., CRISPR-cas gene-editing as plausible treatment of neuromuscular and nucleotide-repeat-expansion diseases: A systematic review. PLoS One. Feb. 22, 2019;14(2):e0212198. doi: 10.1371/journal.pone.0212198.

(56) References Cited

OTHER PUBLICATIONS

Badran et al., Continuous evolution of Bacillus thuringiensis toxins overcomes insect resistance. Nature. May 5, 2016;533(7601):58-63. doi: 10.1038/nature17938. Epub Apr. 27, 2016.
Badran et al., Development of potent in vivo mutagenesis plasmids with broad mutational spectra. Nat Commun. Oct. 7, 2015;6:8425. doi: 10.1038/ncomms9425.
Bae et al., Microhomology-based choice of Cas9 nuclease target sites. Nat Methods. Jul. 2014;11(7):705-6. doi: 10.1038/nmeth.3015.
Bagyinszky et al., Characterization of mutations in PRNP (prion) gene and their possible roles in neurodegenerative diseases. Neuropsychiatr Dis Treat. Aug. 14, 2018;14:2067-2085. doi: 10.2147/NDT.S165445.
Balakrishnan et al., Flap endonuclease 1. Annu Rev Biochem. 2013;82:119-38. doi: 10.1146/annurev-biochem-072511-122603. Epub Feb. 28, 2013.
Banerjee et al., Cadmium inhibits mismatch repair by blocking the ATPase activity of the MSH2-MSH6 complex [published correction appears in Nucleic Acids Res. 2005;33(5):1738]. Nucleic Acids Res. 2005;33(4):1410-1419. Published Mar. 3, 2005. doi:10.1093/nar/gki291.
Baranauskas et al., Generation and characterization of new highly thermostable and processive M-MuLV reverse transcriptase variants. Protein Eng Des Sel. Oct. 2012;25(10):657-68. doi: 10.1093/protein/gzs034. Epub Jun. 12, 2012.
Barnes et al., Repair and genetic consequences of endogenous DNA base damage in mammalian cells. Annu Rev Genet. 2004;38:445-76.
Barrangou et al., CRISPR provides acquired resistance against viruses in prokaryotes. Science. Mar. 23, 2007;315(5819):1709-12.
Barrangou, RNA-mediated programmable DNA cleavage. Nat Biotechnol. Sep. 2012;30(9):836-8. doi: 10.1038/nbt.2357.
Bartlett et al., Efficient expression of protein coding genes from the murine U1 small nuclear RNA promoters. Proc Natl Acad Sci U S A. Aug. 20, 1996;93(17):8852-7. doi: 10.1073/pnas.93.17.8852.
Bartosovic et al., N6-methyladenosine demethylase FTO targets pre-mRNAs and regulates alternative splicing and 3'-end processing. Nucleic Acids Res. Nov. 2, 2017;45(19):11356-11370. doi: 10.1093/nar/gkx778.
Basha et al., Influence of cationic lipid composition on gene silencing properties of lipid nanoparticle formulations of siRNA in antigen-presenting cells. Mol Ther. Dec. 2011;19(12):2186-200. doi: 10.1038/mt.2011.190. Epub Oct. 4, 2011.
Basturea et al., Substrate specificity and properties of the *Escherichia coli* 16S rRNA methyltransferase, RsmE. RNA. Nov. 2007;13(11):1969-76. doi: 10.1261/rna.700507. Epub Sep. 13, 2007.
Batey et al., Structure of a natural guanine-responsive riboswitch complexed with the metabolite hypoxanthine. Nature. Nov. 18, 2004;432(7015):411-5.
Beale et al., Comparison of the differential context-dependence of DNA deamination by APOBEC enzymes: correlation with mutation spectra in vivo. J Mol Biol. Mar. 26, 2004;337(3):585-96.
Bebenek et al., Error-prone polymerization by HIV-1 reverse transcriptase. Contribution of template-primer misalignment, miscoding, and termination probability to mutational hot spots. J Biol Chem. May 15, 1993;268(14):10324-34.
Bedell et al., In vivo genome editing using a high-efficiency TALEN system. Nature. Nov. 1, 2012;491(7422):114-8. Doi: 10.1038/nature11537. Epub Sep. 23, 2012.
Begley, Scientists unveil the 'most clever CRISPR gadget' so far. STAT, Apr. 20, 2016. https://www.statnews.com/2016/04/20/clever-crispr-advance-unveiled/.
Belshaw et al., Controlling programmed cell death with a cyclophilin-cyclosporin-based chemical inducer of dimerization. Chem Biol. Sep. 1996;3(9):731-8. doi: 10.1016/s1074-5521(96)90249-5.
Belshaw et al., Controlling protein association and subcellular localization with a synthetic ligand that induces heterodimerization of proteins. Proc Natl Acad Sci U S A. May 14, 1996;93(10):4604-7. doi: 10.1073/pnas.93.10.4604.
Berkhout et al., Identification of an active reverse transcriptase enzyme encoded by a human endogenous HERV-K retrovirus. J Virol. Mar. 1999;73(3):2365-75. doi: 10.1128/JVI.73.3.2365-2375.1999.
Bernhart et al., Local RNA base pairing probabilities in large sequences. Bioinformatics. Mar. 1, 2006;22(5):614-5. doi: 10.1093/bioinformatics/btk014. Epub Dec. 20, 2005.
Bershtein et al., Advances in laboratory evolution of enzymes. Curr Opin; Chem Biol. Apr. 2008;12(2):151-8. doi: 10.1016/j.cbpa.2008.01.027. Epub Mar. 7, 2008. Review.
Bertolotti et al., Toward genosafe endonuclease-boosted gene targeting using breakthrough CRISP/Cas9 for next generation stem cell gene therapy culminating in efficient ex Vivo in Vivo gene repair/genomic editing. Molecular Therapy. May 2015;23(Suppl1):S139. Abstract 350. 18th Ann Meeting of the American Society of Gene and Cell Therapy. ASGCT 2015. New Orleans, LA. May 13, 2015-May 16, 2015.
Bertrand et al., Localization of ASH1 mRNA particles in living yeast. Mol Cell. Oct. 1998;2(4):437-45. doi: 10.1016/s1097-2765(00)80143-4.
Beumer et al., Efficient gene targeting in *Drosophila* with zinc-finger nucleases. Genetics. Apr. 2006;172(4):2391-403. Epub Feb. 1, 2006.
Bi et al., Pseudo attP sites in favor of transgene integration and expression in cultured porcine cells identified by Streptomyces phage phiC31 integrase. BMC Mol Biol. Sep. 8, 2013;14:20. doi: 10.1186/1471-2199-14-20.
Bibb et al., Integration and excision by the large serine recombinase phiRv1 integrase. Mol Microbiol. Mar. 2005;55(6):1896-910. doi: 10.1111/j.1365-2958.2005.04517.x.
Biehs et al., DNA Double-Strand Break Resection Occurs during Non-homologous End Joining in G1 but Is Distinct from Resection during Homologous Recombination. Mol Cell. Feb. 16, 2017;65(4):671-684.e5. doi: 10.1016/j.molcel.2016.12.016. Epub Jan. 26, 2017.
Billon et al., CRISPR-Mediated Base Editing Enables Efficient Disruption of Eukaryotic Genes through Induction of STOP Codons. Mol Cell. Sep. 21, 2017;67(6):1068-1079.e4. doi: 10.1016/j.molcel.2017.08.008. Epub Sep. 7, 2017.
Birling et al., Site-specific recombinases for manipulation of the mouse genome. Methods Mol Biol. 2009;561:245-63. doi: 10.1007/978-1-60327-019-9_16.
Biswas et al., A structural basis for allosteric control of DNA recombination by lambda integrase. Nature. Jun. 23, 2005;435(7045):1059-66. doi: 10.1038/nature03657.
Bitinaite et al., FokI dimerization is required for DNA cleavage. Proc Natl Acad Sci U S A. Sep. 1, 1998;95(18):10570-5.
Blain et al., Nuclease activities of Moloney murine leukemia virus reverse transcriptase. Mutants with altered substrate specificities. J Biol Chem. Nov. 5, 1993;268(31):23585-92.
Blau et al., A proliferation switch for genetically?modified?cells. PNAS Apr. 1, 1997 94 (7) 3076-3081; https://doi.org/10.1073/pnas.94.7.3076.
Bloom et al., Evolving strategies for enzyme engineering. Curr Opin Struct Biol. Aug. 2005;15(4):447-52.
Boch, TALEs of genome targeting. Nat Biotechnol. Feb. 2011;29(2):135-6. Doi: 10.1038/nbt.1767.
Böck et al., Selenocysteine: the 21st amino acid. Mol Microbiol. Mar. 1991;5(3):515-20.
Bodi et al., Yeast m6A Methylated mRNAs Are Enriched on Translating Ribosomes during Meiosis, and under Rapamycin Treatment. PLoS One. Jul. 17, 2015;10(7):e0132090. doi: 10.1371/journal.pone.0132090.
Boeckle et al., Melittin analogs with high lytic activity at endosomal pH enhance transfection with purified targeted PEI polyplexes. J Control Release. May 15, 2006;112(2):240-8. Epub Mar. 20, 2006.
Boersma et al., Selection strategies for improved biocatalysts. FEBS J. May 2007;274(9):2181-95.
Bogdanove et al., Engineering altered protein-DNA recognition specificity. Nucleic Acids Res. Jun. 1, 2018;46(10):4845-4871. doi: 10.1093/nar/gky289.
Bogdanove et al., TAL effectors: customizable proteins for DNA targeting. Science. Sep. 30, 2011;333(6051):1843-6. doi: 10.1126/science.1204094.

(56) References Cited

OTHER PUBLICATIONS

Bohlke et al., Sense codon emancipation for proteome-wide incorporation of noncanonical amino acids: rare isoleucine codon AUA as a target for genetic code expansion. FEMS Microbiol Lett. Feb. 2014;351(2):133-44. doi:10.1111/1574-6968.12371. Epub Jan. 27, 2014.
Bolotin et al., Clustered regularly interspaced short palindrome repeats (CRISPRs) have spacers of extrachromosomal origin. Microbiology. Aug. 2005;151(Pt 8):2551-61.
Bolusani et al., Evolution of variants of yeast site-specific recombinase Flp that utilize native genomic sequences as recombination target sites. Nucleic Acids Res. 2006;34(18):5259-69. Epub Sep. 26, 2006.
Borchardt et al., Controlling mRNA stability and translation with the CRISPR endoribonuclease Csy4. RNA. Nov. 2015;21(11):1921-30. doi: 10.1261/rna.051227.115. Epub Sep. 9, 2015.
Borman, Improved route to single-base genome editing. Chemical & Engineering News, Apr. 25, 2016;94(17)p5. http://cen.acs.org/articles/94/i17/Improved-route-single-base-genome.html.
Boutabout et al., DNA synthesis fidelity by the reverse transcriptase of the yeast retrotransposon Ty1. Nucleic Acids Res. Jun. 1, 2001;29(11):2217-22. doi: 10.1093/nar/29.11.2217.
Box et al., A multi-domain protein system based on the HC fragment of tetanus toxin for targeting DNA to neuronal cells. J Drug Target. Jul. 2003;11(6):333-43. doi: 10.1080/1061186310001634667.
Branden and Tooze, Introduction to Protein Structure. 1999; 2nd edition. Garland Science Publisher: 3-12.
Braun et al., Immunogenic duplex nucleic acids are nuclease resistant. J Immunol. Sep. 15, 1988;141(6):2084-9.
Briner et al., Guide RNA functional modules direct Cas9 activity and orthogonality. Mol Cell. Oct. 23, 2014;56(2):333-339. doi: 10.1016/j.molcel.2014.09.019.
Britt et al., Re-engineering plant gene targeting. Trends Plant Sci. Feb. 2003;8(2):90-5.
Brouns et al., Small CRISPR RNAs guide antiviral defense in prokaryotes. Science. Aug. 15, 2008;321(5891):960-4. doi: 10.1126/science.1159689.
Brown et al., Serine recombinases as tools for genome engineering. Methods. Apr. 2011;53(4):372-9. doi: 10.1016/j.ymeth.2010.12.031. Epub Dec. 30, 2010.
Brown et al., Characterization of the genetic elements required for site-specific integration of plasmid pSE211 in Saccharopolyspora erythraea. J Bacteriol. Apr. 1990;172(4):1877-88. doi: 10.1128/jb.172.4.1877-1888.1990.
Brown et al., Structural insights into the stabilization of MALAT1 noncoding RNA by a bipartite triple helix. Nat Struct Mol Biol. Jul. 2014;21(7):633-40. doi: 10.1038/nsmb.2844. Epub Jun. 22, 2014.
Brusse et al., Spinocerebellar ataxia associated with a mutation in the fibroblast growth factor 14 gene (SCA27): A new phenotype. Mov Disord. Mar. 2006;21(3):396-401.
Brzezicha et al., Identification of human tRNA:m5C methyltransferase catalysing intron-dependent m5C formation in the first position of the anticodon of the pre-tRNA Leu (CAA). Nucleic Acids Res. 2006;34(20):6034-43. doi: 10.1093/nar/gk1765. Epub Oct. 27, 2006.
Buchholz et al., Alteration of Cre recombinase site specificity by substrate-linked protein evolution. Nat Biotechnol. Nov. 2001;19(11):1047-52.
Buchschacher et al., Human immunodeficiency virus vectors for inducible expression of foreign genes. J Virol. May 1992;66(5):2731-9. doi: 10.1128/JVI.66.5.2731-2739.1992.
Buchwald et al., Long-term, continuous intravenous heparin administration by an implantable infusion pump in ambulatory patients with recurrent venous thrombosis. Surgery. Oct. 1980;88(4):507-16.
Budisa et al., Residue-specific bioincorporation of non-natural, biologically active amino acids into proteins as possible drug carriers: structure and stability of the per-thiaproline mutant of annexin V. Proc Natl Acad Sci U S A. Jan. 20, 1998;95(2):455-9.
Budker et al., Protein/amphipathic polyamine complexes enable highly efficient transfection with minimal toxicity. Biotechniques. Jul. 1997;23(1):139, 142-7. doi: 10.2144/97231rr02.
Budworth et al., A brief history of triplet repeat diseases. Methods Mol Biol. 2013;1010:3-17. doi: 10.1007/978-1-62703-411-1_1.
Bulow et al., Multienzyme systems obtained by gene fusion. Trends Biotechnol. Jul. 1991;9(7):226-31.
Burke et al., RNA Aptamers to the Adenosine Moiety of S-adenosyl Methionine: Structural Inferences From Variations on a Theme and the Reproducibility of SELEX. Nucleic Acids Res. May 15, 1997;25(10):2020-4. doi: 10.1093/nar/25.10.2020.
Burstein et al., New CRISPR-Cas systems from uncultivated microbes. Nature Feb. 2017;542(7640):237-240.
Buskirk et al., Directed evolution of ligand dependence: small-molecule-activated protein splicing. Proc Natl Acad Sci U S A. Jul. 20, 2004;101(29):10505-10. Epub Jul. 9, 2004.
Byrne et al., Multiplex gene regulation: a two-tiered approach to transgene regulation in transgenic mice. Proc Natl Acad Sci U S A. Jul. 1989;86(14):5473-7. doi: 10.1073/pnas.86.14.5473.
Cade et al., Highly efficient generation of heritable zebrafish gene mutations using homo- and heterodimeric TALENs. Nucleic Acids Res. Sep. 2012;40(16):8001-10. Doi: 10.1093/nar/gks518. Epub Jun. 7, 2012.
Cadwell et al., Randomization of genes by PCR mutagenesis. PCR Methods Appl. Aug. 1992;2(1):28-33. doi: 10.1101/gr.2.1.28.
Cai et al., Reconstruction of ancestral protein sequences and its applications. BMC Evol Biol. Sep. 17, 2004;4:33. doi: 10.1186/1471-2148-4-33.
Caldecott et al., Single-strand break repair and genetic disease. Nat Rev Genet. Aug. 2008;9(8):619-31. doi: 10.1038/nrg2380.
Cameron, Recent advances in transgenic technology. Mol Biotechnol. Jun. 1997;7(3):253-65.
Camper et al., Postnatal repression of the alpha-fetoprotein gene is enhancer independent. Genes Dev. Apr. 1989;3(4):537-46. doi: 10.1101/gad.3.4.537.
Camps et al., Targeted gene evolution in *Escherichia coli* using a highly error-prone DNA polymerase I. Proc Natl Acad Sci U S A. Aug. 19, 2003;100(17):9727-32. Epub Aug. 8, 2003.
Canchaya et al., Genome analysis of an inducible prophage and prophage remnants integrated in the *Streptococcus pyogenes* strain SF370. Virology. Oct. 25, 2002;302(2):245-58. doi: 10.1006/viro.2002.1570.
Canver et al., Customizing the genome as therapy for the ?-hemoglobinopathies. Blood. May 26, 2016;127(21):2536-45. doi: 10.1182/blood-2016-01-678128. Epub Apr. 6, 2016.
Cargill et al., Characterization of single-nucleotide polymorphisms in coding regions of human genes. Nat Genet. Jul. 1999;22(3):231-8.
Carlson et al., Negative selection and stringency modulation in phage-assisted continuous evolution. Nat Chem Biol. Mar. 2014;10(3):216-22. doi: 10.1038/nchembio.1453. Epub Feb. 2, 2014. With Supplementary Results.
Caron et al., Intracellular delivery of a Tat-eGFP fusion protein into muscle cells. Mol Ther. Mar. 2001;3(3):310-8.
Carroll et al., Gene targeting in *Drosophila* and Caenorhabditis elegans with zinc-finger nucleases. Methods Mol Biol. 2008;435:63-77. doi: 10.1007/978-1-59745-232-8_5.
Carroll et al., Progress and prospects: zinc-finger nucleases as gene therapy agents. Gene Ther. Nov. 2008;15(22):1463-8. doi: 10.1038/gt.2008.145. Epub Sep. 11, 2008.
Carroll, A CRISPR approach to gene targeting. Mol Ther. Sep. 2012;20(9):1658-60. doi: 10.1038/mt.2012.171.
Carroll, Genome engineering with zinc-finger nucleases. Genetics. Aug. 2011;188(4):773-82. doi: 10.1534/genetics.111.131433. Review.
Carvalho et al., Evolution in health and medicine Sackler colloquium: Genomic disorders: a window into human gene and genome evolution. Proc Natl Acad Sci U S A. Jan. 26, 2010;107 Suppl 1(Suppl 1):1765-71. doi: 10.1073/pnas.0906222107. Epub Jan. 13, 2010.
Caspi et al., Distribution of split DnaE inteins in cyanobacteria. Mol Microbiol. Dec. 2003;50(5):1569-77. doi: 10.1046/j.1365-2958.2003.03825.x.
Cattaneo et al., SEL1L affects human pancreatic cancer cell cycle and invasiveness through modulation of PTEN and genes related to cell-matrix interactions. Neoplasia. 2005;7(11):1030-1038.

(56) References Cited

OTHER PUBLICATIONS

Ceccaldi et al., Repair Pathway Choices and Consequences at the Double-Strand Break. Trends Cell Biol. Jan. 2016;26(1):52-64. doi: 10.1016/j.tcb.2015.07.009. Epub Oct. 1, 2015.

Cermak et al., Efficient design and assembly of custom TALEN and other TAL effector-based constructs for DNA targeting. Nucleic Acids Res. Jul. 2011;39(12):e82. Doi: 10.1093/nar/gkr218. Epub Apr. 14, 2011.

Chadalavada et al., Wild-type is the optimal sequence of the HDV ribozyme under cotranscriptional conditions. RNA. Dec. 2007;13(12):2189-201. doi: 10.1261/rna.778107. Epub Oct. 23, 2007.

Chadwick et al., In Vivo Base Editing of PCSK9 (Proprotein Convertase Subtilisin/Kexin Type 9) as a Therapeutic Alternative to Genome Editing. Arterioscler Thromb Vasc Biol. Sep. 2017;37(9):1741-1747. doi: 10.1161/ATVBAHA.117.309881. Epub Jul. 27, 2017.

Chaikind et al., A programmable Cas9-serine recombinase fusion protein that operates on DNA sequences in mammalian cells. Nucleic Acids Res. Nov. 16, 2016;44(20):9758-9770. Epub Aug. 11, 2016.

Chalberg et al., phiC31 integrase confers genomic integration and long-term transgene expression in rat retina. Invest Ophthalmol Vis Sci. Jun. 2005;46(6):2140-6. doi: 10.1167/iovs.04-1252.

Chan et al., Molecular recording of mammalian embryogenesis. Nature. Jun. 2019;570(7759):77-82. doi: 10.1038/s41586-019-1184-5. Epub May 13, 2019.

Chapman et al., Playing the end game: DNA double-strand break repair pathway choice. Mol Cell. Aug. 24, 2012;47(4):497-510. doi: 10.1016/j.molcel.2012.07.029.

Charpentier et al., Biotechnology: Rewriting a genome. Nature. Mar. 7, 2013;495(7439):50-1. doi: 10.1038/495050a.

Chaturvedi et al., Stabilization of triple-stranded oligonucleotide complexes: use of probes containing alternating phosphodiester and stereo-uniform cationic phosphoramidate linkages. Nucleic Acids Res. Jun. 15, 1996;24(12):2318-23.

Chavez et al., Highly efficient Cas9-mediated transcriptional programming. Nat Methods. Apr. 2015;12(4):326-8. doi: 10.1038/nmeth.3312. Epub Mar. 2, 2015.

Chavez et al., Precise Cas9 targeting enables genomic mutation prevention. Proc Natl Acad Sci U S A. Apr. 3, 2018;115(14):3669-3673. doi: 10.1073/pnas.1718148115. Epub Mar. 19, 2018. bioRxiv preprint first posted online Jun. 14, 2016.

Chelico et al., Biochemical basis of immunological and retroviral responses to DNA-targeted cytosine deamination by activation-induced cytidine deaminase and APOBEC3G. J Biol Chem. Oct. 9, 2009;284(41):27761-5. doi: 10.1074/jbc.R109.052449. Epub Aug. 13, 2009.

Chelico et al., Stochastic properties of processive cytidine DNA deaminases AID and APOBEC3G. Philos Trans R Soc Lond B Biol Sci. Mar. 12, 2009;364(1517):583-93. doi: 10.1098/rstb.2008.0195.

Chen et al., Enhanced proofreading governs CRISPR-Cas9 targeting accuracy. Nature. Oct. 19, 2017;550(7676):407-410. doi: 10.1038/nature24268. Epub Sep. 20, 2017.

Chen et al., Fusion protein linkers: property, design and functionality. Adv Drug Deliv Rev. Oct. 2013;65(10):1357-69. doi: 10.1016/j.addr.2012.09.039. Epub Sep. 29, 2012.

Chen et al., Highly Efficient Mouse Genome Editing by CRISPR Ribonucleoprotein Electroporation of Zygotes. J Biol Chem. Jul. 8, 2016;291(28):14457-67. doi: 10.1074/jbc.M116.733154. Epub May 5, 2016.

Chen et al., m(6)A RNA methylation is regulated by microRNAs and promotes reprogramming to pluripotency. Cell Stem Cell. Mar. 5, 2015;16(3):289-301. doi: 10.1016/j.stem.2015.01.016. Epub Feb. 12, 2015.

Chen et al., Structure of the DNA deaminase domain of the HIV-1 restriction factor APOBEC3G. Nature. Mar. 6, 2008;452(7183):116-9. doi: 10.1038/nature06638. Epub Feb. 20, 2008.

Chesnoy et al., Structure and function of lipid-DNA complexes for gene delivery. Annu Rev Biophys Biomol Struct. 2000;29:27-47.

Chew et al., A multifunctional AAV-CRISPR-Cas9 and its host response. Nat Methods. Oct. 2016;13(10):868-74. doi: 10.1038/nmeth.3993. Epub Sep. 5, 2016.

Chichili et al., Linkers in the structural biology of protein-protein interactions. Protein Science. 2013;22:153-67.

Chin, Expanding and reprogramming the genetic code of cells and animals. Annu Rev Biochem. 2014;83:379-408. doi: 10.1146/annurev-biochem-060713-035737. Epub Feb. 10, 2014.

Chipev et al., A leucine—proline mutation in the H1 subdomain of keratin 1 causes epidermolytic hyperkeratosis. Cell. Sep. 4, 1992;70(5):821-8.

Cho et al., Analysis of off-target effects of CRISPR/Cas-derived RNA-guided endonucleases and nickases. Genome Res. Jan. 2014;24(1):132-41. doi: 10.1101/gr.162339.113. Epub Nov. 19, 2013.

Cho et al., Site-specific recombination of bacteriophage P22 does not require integration host factor. J Bacteriol. Jul. 1999;181(14):4245-9. doi: 10.1128/JB.181.14.4245-4249.1999.

Cho et al., Targeted genome engineering in human cells with the Cas9 RNA-guided endonuclease. Nat Biotechnol. Mar. 2013;31(3):230-2. doi: 10.1038/nbt.2507. Epub Jan. 29, 2013.

Choe et al., Forging Ahead through Darkness: PCNA, Still the Principal Conductor at the Replication Fork. Mol Cell. Feb. 2, 2017;65(3):380-392. doi: 10.1016/j.molcel.2016.12.020.

Choi et al., N(6)-methyladenosine in mRNA disrupts tRNA selection and translation-elongation dynamics. Nat Struct Mol Biol. Feb. 2016;23(2):110-5. doi: 10.1038/nsmb.3148. Epub Jan. 11, 2016.

Chong et al., Modulation of protein splicing of the *Saccharomyces cerevisiae* vacuolar membrane ATPase intein. J Biol Chem. Apr. 24, 1998;273(17):10567-77. doi: 10.1074/jbc.273.17.10567.

Chong et al., Utilizing the C-terminal cleavage activity of a protein splicing element to purify recombinant proteins in a single chromatographic step. Nucleic Acids Res. Nov. 15, 1998;26(22):5109-15. doi: 10.1093/nar/26.22.5109.

Chong et al., Protein splicing involving the *Saccharomyces cerevisiae* VMA intein. The steps in the splicing pathway, side reactions leading to protein cleavage, and establishment of an in vitro splicing system. J Biol Chem. Sep. 6, 1996;271(36):22159-68. doi: 10.1074/jbc.271.36.22159.

Chong et al., Protein splicing of the *Saccharomyces cerevisiae* VMA intein without the endonuclease motifs. J Biol Chem. Jun. 20, 1997;272(25):15587-90. doi: 10.1074/jbc.272.25.15587.

Choudhury et al., Engineering RNA endonucleases with customized sequence specificities. Nat Commun. 2012;3:1147. doi: 10.1038/ncomms2154.

Christian et al, Targeting G with TAL effectors: a comparison of activities of TALENs constructed with NN and NK repeat variable di-residues. PLoS One. 2012;7(9):e45383. doi: 10.1371/journal.pone.0045383. Epub Sep. 24, 2012.

Christian et al., Targeting DNA double-strand breaks with TAL effector nucleases. Genetics. Oct. 2010;186(2):757-61. Doi: 10.1534/genetics.110.120717. Epub Jul. 26, 2010.

Christiansen et al., Characterization of the lactococcal temperate phage TP901-1 and its site-specific integration. J Bacteriol. Feb. 1994;176(4):1069-76. doi: 10.1128/jb.176.4.1069-1076.1994.

Chu et al., Increasing the efficiency of homology-directed repair for CRISPR-Cas9-induced precise gene editing in mammalian cells. Nat Biotech. Feb. 13, 2015;33:543-8.

Chuai et al., DeepCRISPR: optimized CRISPR guide RNA design by deep learning. Genome Biol. Jun. 26, 2018;19(1):80. doi: 10.1186/s13059-018-1459-4.

Chuai et al., In Silico Meets In Vivo: Towards Computational CRISPR-Based sgRNA Design. Trends Biotechnol. Jan. 2017;35(1):12-21. doi: 10.1016/j.tibtech.2016.06.008. Epub Jul. 11, 2016.

Chuang et al., Novel Heterotypic Rox Sites for Combinatorial Dre Recombination Strategies. G3 (Bethesda). Dec. 29, 2015;6(3):559-71. doi: 10.1534/g3.115.025841.

Chujo et al, Trmt61B is a methyltransferase responsible for 1-methyladenosine at position 58 of human mitochondrial tRNAs. RNA. Dec. 2012;18(12):2269-76. doi: 10.1261/rna.035600.112. Epub Oct. 24, 2012.

(56) References Cited

OTHER PUBLICATIONS

Chung-Il et al., Artificial control of gene expression in mammalian cells by modulating RNA interference through aptamer-small molecule interaction. RNA. May 2006;12(5):710-6. Epub Apr. 10, 2006.
Chylinski et al., The tracrRNA and Cas9 families of type II CRISPR-Cas immunity systems. RNA Biol. May 2013;10(5):726-37. doi: 10.4161/rna.24321. Epub Apr. 5, 2013.
Clackson et al., Redesigning an FKBP-ligand interface to generate chemical dimerizers with novel specificity. Proc Natl Acad Sci U S A. Sep. 1, 1998;95(18):10437-42. doi: 10.1073/pnas.95.18.10437.
Clement et al., CRISPResso2 provides accurate and rapid genome editing sequence analysis. Nat Biotechnol. Mar. 2019;37(3):224-226. doi: 10.1038/s41587-019-0032-3.
Cobb et al., Directed evolution as a powerful synthetic biology tool. Methods. Mar. 15, 2013;60(1):81-90. doi: 10.1016/j.ymeth.2012.03.009. Epub Mar. 23, 2012.
Cokol et al., Finding nuclear localization signals. EMBO Rep. Nov. 2000;1(5):411-5. doi: 10.1093/embo-reports/kvd092.
Cole-Strauss et al., Correction of the mutation responsible for sickle cell anemia by an RNA-DNA oligonucleotide. Science. Sep. 6, 1996;273(5280):1386-9.
Cong et al., Multiplex genome engineering using CRISPR/Cas systems. Science. Feb. 15, 2013;339(6121):819-23. doi: 10.1126/science.1231143. Epub Jan. 3, 2013.
Conrad et al., A Kaposi's sarcoma virus RNA element that increases the nuclear abundance of intronless transcripts. EMBO J. May 18, 2005;24(10):1831-41. doi: 10.1038/sj.emboj.7600662. Epub Apr. 28, 2005.
Conticello, The AID/APOBEC family of nucleic acid mutators. Genome Biol. 2008;9(6):229. doi: 10.1186/gb-2008-9-6-229. Epub Jun. 17, 2008.
Cornu et al., Refining strategies to translate genome editing to the clinic. Nat Med. Apr. 3, 2017;23(4):415-423. doi: 10.1038/nm.4313.
Costa et al., Frequent use of the same tertiary motif by self-folding RNAs. EMBO J. Mar. 15, 1995;14(6):1276-85.
Covino et al., The CCL2/CCR2 Axis in the Pathogenesis of HIV-1 Infection: A New Cellular Target for Therapy? Current Drug Targets Dec. 2016;17(1):76-110. DOI: 10.2174/1389450117011512171110917.
Cox et al., Conditional gene expression in the mouse inner ear using Cre-loxP. J Assoc Res Otolaryngol. Jun. 2012;13(3):295-322. doi: 10.1007/s10162-012-0324-5. Epub Apr. 24, 2012.
Cox et al., RNA editing with CRISPR-Cas13. Science. Nov. 24, 2017;358(6366):1019-1027. doi: 10.1126/science.aaq0180. Epub Oct. 25, 2017.
Cox et al., Therapeutic genome editing: prospects and challenges. Nat Med. Feb. 2015;21(2):121-31. doi: 10.1038/nm.3793.
Cradick et al., CRISPR/Cas9 systems targeting β-globin and CCR5 genes have substantial off-target activity. Nucleic Acids Res. Nov. 1, 2013;41(20):9584-92. doi: 10.1093/nar/gkt714. Epub Aug. 11, 2013.
Cradick et al., ZFN-site searches genomes for zinc finger nuclease target sites and off-target sites. BMC Bioinformatics. May 13, 2011;12:152. doi: 10.1186/1471-2105-12-152.
Cradick et al., Zinc-finger nucleases as a novel therapeutic strategy for targeting hepatitis B virus DNAs. Mol Ther. May 2010;18(5):947-54. Doi: 10.1038/mt.2010.20. Epub Feb. 16, 2010.
Cui et al., m6A RNA Methylation Regulates the Self-Renewal and Tumorigenesis of Glioblastoma Stem Cells. Cell Rep. Mar. 14, 2017;18(11):2622-2634. doi: 10.1016/j.celrep.2017.02.059.
Cui et al., Review of CRISPR/Cas9 sgRNA Design Tools. Interdiscip Sci. Jun. 2018;10(2):455-465. doi: 10.1007/s12539-018-0298-z. Epub Apr. 11, 2018.
Cui et al., Targeted integration in rat and mouse embryos with zinc-finger nucleases. Nat Biotechnol. Jan. 2011;29(1):64-7. Doi: 10.1038/nbt.1731. Epub Dec. 12, 2010.
Cunningham et al., Ensembl 2015. Nucleic Acids Res. Jan. 2015;43(Database issue):D662-9. doi: 10.1093/nar/gku1010. Epub Oct. 28, 2014.
Cupples et al., A set of lacZ mutations in *Escherichia coli* that allow rapid detection of each of the six base substitutions. Proc Natl Acad Sci U S A. Jul. 1989;86(14):5345-9.
D'adda di Fagagna et al., The Gam protein of bacteriophage Mu is an orthologue of eukaryotic Ku. EMBO Rep. Jan. 2003;4(1):47-52.
Dahlem et al., Simple methods for generating and detecting locus-specific mutations induced with TALENs in the zebrafish genome. PLoS Genet. 2012;8(8):e1002861. doi: 10.1371/journal.pgen.1002861. Epub Aug. 16, 2012.
Dahlgren et al., A novel mutation in ribosomal protein S4 that affects the function of a mutated RF1. Biochimie. Aug. 2000;82(8):683-91.
Dahlman et al., Orthogonal gene knockout and activation with a catalytically active Cas9 nuclease. Nat Biotechnol. Nov. 2015;33(11):1159-61. doi: 10.1038/nbt.3390.
Dang et al., Optimizing sgRNA structure to improve CRISPR-Cas9 knockout efficiency. Genome Biol. Dec. 15, 2015;16:280. doi: 10.1186/s13059-015-0846-3.
Das et al.,The crystal structure of the monomeric reverse transcriptase from Moloney murine leukemia virus. Structure. May 2004;12(5):819-29. doi: 10.1016/j.str.2004.02.032.
Dassa et al., Fractured genes: a novel genomic arrangement involving new split inteins and a new homing endonuclease family. Nucleic Acids Res. May 2009;37(8):2560-73. doi: 10.1093/nar/gkp095. Epub Mar. 5, 2009.
Database EBI Accession No. ADE34233 Jan. 29, 2004.
Database EBI Accession No. BFF09785.
Database EBI Accession No. BGE38086.
Database UniProt Accession No. G8I3E0. Jan. 14, 2012.
Datsenko et al., One-step inactivation of chromosomal genes in *Escherichia coli* K-12 using PCR products. Proc Natl Acad Sci U S A. Jun. 6, 2000;97(12):6640-5.
Davis et al., DNA double strand break repair via non-homologous end-joining. Transl Cancer Res. Jun. 2013;2(3):130-143. doi: 10.3978/j.issn.2218-676X.2013.04.02.
Davis et al., Small molecule-triggered Cas9 protein with improved genome-editing specificity. Nat Chem Biol. May 2015;11(5):316-8. doi: 10.1038/nchembio.1793. Epub Apr. 6, 2015.
De Felipe et al., Co-translational, intraribosomal cleavage of polypeptides by the foot-and-mouth disease virus 2A peptide. J Biol Chem. Mar. 28, 2003;278(13):11441-8. doi: 10.1074/jbc.M211644200. Epub Jan. 8, 2003.
De Souza, Primer: genome editing with engineered nucleases. Nat Methods. Jan. 2012;9(1):27.
De Wit et al., The Human CD4+ T Cell Response against Mumps Virus Targets a Broadly Recognized Nucleoprotein Epitope. J Virol. Mar. 5, 2019;93(6):e01883-18. doi: 10.1128/JVI.01883-18.
Dean et al., Genetic restriction of HIV-1 infection and progression to AIDS by a deletion allele of the CKR5 structural gene. Hemophilia Growth and Development Study, Multicenter AIDS Cohort Study, Multicenter Hemophilia Cohort Study, San Francisco City Cohort, ALIVE Study. Science. Sep. 27, 1996;273(5283):1856-62. doi: 10.1126/science.273.5283.1856.
Deltcheva et al., CRISPR RNA maturation by trans-encoded small RNA and host factor RNase III. Nature. Mar. 31, 2011;471(7340):602-7. doi: 10.1038/nature09886.
Deng et al., Widespread occurrence of N6-methyladenosine in bacterial mRNA. Nucleic Acids Res. Jul. 27, 2015;43(13):6557-67. doi: 10.1093/nar/gkv596. Epub Jun. 11, 2015.
Deriano et al., Modernizing the nonhomologous end-joining repertoire: alternative and classical NHEJ share the stage. Annu Rev Genet. 2013;47:433-55. doi: 10.1146/annurev-genet-110711-155540. Epub Sep. 11, 2013.
Deussing, Targeted mutagenesis tools for modelling psychiatric disorders. Cell Tissue Res. Oct. 2013;354(1):9-25. doi: 10.1007/s00441-013-1708-5. Epub Sep. 10, 2013.
Dever et al., CRISPR/Cas9 ?-globin gene targeting in human haematopoietic stem cells. Nature. Nov. 17, 2016;539(7629):384-389. doi: 10.1038/nature20134. Epub Nov. 7, 2016.
Dicarlo et al., Genome engineering in *Saccharomyces cerevisiae* using CRISPR-Cas systems. Nucleic Acids Res. Apr. 2013;41(7):4336-43. doi: 10.1093/nar/gkt135. Epub Mar. 4, 2013.

(56) References Cited

OTHER PUBLICATIONS

Dicarlo et al., Safeguarding CRISPR-Cas9 gene drives in yeast. Nat Biotechnol. Dec. 2015;33(12):1250-1255. doi: 10.1038/nbt.3412. Epub Nov. 16, 2015.
Dickinson et al., Experimental interrogation of the path dependence and stochasticity of protein evolution using phage-assisted continuous evolution. Proc Natl Acad Sci USA. May 2013;110(22):9007-12.
Ding et al., A TALEN genome-editing system for generating human stem cell-based disease models. Cell Stem Cell. Feb. 7, 2013;12(2):238-51. Doi: 10.1016/j.stem.2012.11.011. Epub Dec. 13, 2012.
Ding et al., Permanent alteration of PCSK9 with in vivo CRISPR-Cas9 genome editing. Circ Res. Aug. 15, 2014;115(5):488-92. doi: 10.1161/CIRCRESAHA.115.304351. Epub Jun. 10, 2014.
Dixon et al., Reengineering orthogonally selective riboswitches. Proc Natl Acad Sci U S A. Feb. 16, 2010;107(7):2830-5. doi: 10.1073/pnas.0911209107. Epub Jan. 26, 2010.
Doench et al., Optimized sgRNA design to maximize activity and minimize off-target effects of CRISPR-Cas9. Nat Biotechnol. Feb. 2016;34(2):184-191. doi: 10.1038/nbt.3437.
Dormiani et al., Long-term and efficient expression of human ?-globin gene in a hematopoietic cell line using a new site-specific integrating non-viral system. Gene Ther. Aug. 2015;22(8):663-74. doi: 10.1038/gt.2015.30. Epub Apr. 1, 2015.
Doudna et al., Genome editing. The new frontier of genome engineering with CRISPR-Cas9. Science. Nov. 28, 2014;346(6213):1258096. doi: 10.1126/science.1258096.
Dove et al., Conversion of the omega subunit of *Escherichia coli* RNA polymerase into a transcriptional activator or an activation target. Genes Dev. Mar. 1, 1998;12(5):745-54.
Doyon et al., Directed evolution and substrate specificity profile of homing endonuclease I-SceI. J Am Chem Soc. Feb. 22, 2006;128(7):2477-84.
Doyon et al., Heritable targeted gene disruption in zebrafish using designed zinc-finger nucleases. Nat Biotechnol. Jun. 2008;26(6):702-8. Doi: 10.1038/nbt1409. Epub May 25, 2008.
Drake, A constant rate of spontaneous mutation in DNA-based microbes. Proc Natl Acad Sci U S A. Aug. 15, 1991;88(16):7160-4.
Dubois et al., Retroviral RNA Dimerization: From Structure to Functions. Front Microbiol. Mar. 22, 2018;9:527. doi: 10.3389/fmicb.2018.00527.
Dumas et al., Designing logical codon reassignment—Expanding the chemistry in biology. Chem Sci. Jan. 1, 2015;6(1):50-69. doi: 10.1039/c4sc01534g. Epub Jul. 14, 2014. Review.
Dunaime, Breakthrough method means CRISPR just got a lot more relevant to human health. The Verge. Apr. 20, 2016. http://www.theverge.com/2016/4/20/11450262/crispr-base-editing-single-nucleotides-dna-gene-liu-harvard.
Durai et al., A bacterial one-hybrid selection system for interrogating zinc finger-DNA interactions. Comb Chem High Throughput Screen. May 2006;9(4):301-11.
Durai et al., Zinc finger nucleases: custom-designed molecular scissors for genome engineering of plant and mammalian cells. Nucleic Acids Res. Oct. 26, 2005;33(18):5978-90. doi: 10.1093/nar/gki912.
During et al., Controlled release of dopamine from a polymeric brain implant: in vivo characterization. Ann Neurol. Apr. 1989;25(4):351-6.
East-Seletsky et al., Two distinct RNase activities of CRISPR-C2c2 enable guide-RNA processing and RNA detection. Nature Oct. 2016;538(7624):270-3.
Edwards et al., An *Escherichia coli* tyrosine transfer RNA is a leucine-specific transfer RNA in the yeast *Saccharomyces cerevisiae*. Proc Natl Acad Sci U S A. Feb. 15, 1991;88(4):1153-6.
Edwards et al., Crystal structures of the thi-box riboswitch bound to thiamine pyrophosphate analogs reveal adaptive RNA-small molecule recognition. Structure. Sep. 2006;14(9):1459-68.
Eick et al., Robustness of Reconstructed Ancestral Protein Functions to Statistical Uncertainty. Mol Biol Evol. Feb. 1, 2017;34(2):247-261. doi: 10.1093/molbev/msw223.

Eiler et al., Structural Basis for the Fast Self-Cleavage Reaction Catalyzed by the Twister Ribozyme. Proc Natl Acad Sci U S A. Sep. 9, 2014;111(36):13028-33. doi: 10.1073/pnas.1414571111. Epub Aug. 25, 2014.
Eltoukhy et al., Nucleic acid-mediated intracellular protein delivery by lipid-like nanoparticles. Biomaterials. Aug. 2014;35(24):6454-61. doi: 10.1016/j.biomaterials.2014.04.014. Epub May 13, 2014.
Endo et al., Toward establishing an efficient and versatile gene targeting system in higher plants. Biocatalysis and Agricultural Biotechnology 2014;3,(1):2-6.
Engel et al., The emerging role of mRNA methylation in normal and pathological behavior. Genes Brain Behav. Mar. 2018;17(3):e12428. doi: 10.1111/gbb.12428. Epub Nov. 17, 2017.
Engelward et al., Base excision repair deficient mice lacking the Aag alkyladenine DNA glycosylase. Proc Natl Acad Sci U S A. Nov. 25, 1997;94(24):13087-92.
Enyeart et al., Biotechnological applications of mobile group II introns and their reverse transcriptases: gene targeting, RNA-seq, and non-coding RNA analysis. Mobile DNA 5, 2 (2014). https://doi.org/10.1186/1759-8753-5-2. https://doi.org/10.1186/1759-8753-5-2.
Esvelt et al., A system for the continuous directed evolution of biomolecules. Nature. Apr. 28, 2011;472(7344):499-503. doi: 10.1038/nature09929. Epub Apr. 10, 2011.
Esvelt et al., Genome-scale engineering for systems and synthetic biology. Mol Syst Biol. 2013;9:641. doi: 10.1038/msb.2012.66.
Esvelt et al., Orthogonal Cas9 proteins for RNA-guided gene regulation and editing. Nat Methods. Nov. 2013;10(11):1116-21. doi: 10.1038/nmeth.2681. Epub Sep. 29, 2013.
Evans et al., Protein trans-splicing and cyclization by a naturally split intein from the dnaE gene of *Synechocystis* species PCC6803. J Biol Chem. Mar. 31, 2000;275(13):9091-4. doi: 10.1074/jbc.275.13.9091.
Evans et al., Semisynthesis of cytotoxic proteins using a modified protein splicing element. Protein Sci. Nov. 1998;7(11):2256-64. doi: 10.1002/pro.5560071103.
Evans et al., The cyclization and polymerization of bacterially expressed proteins using modified self-splicing inteins. J Biol Chem. Jun. 25, 1999;274(26):18359-63. doi: 10.1074/jbc.274.26.18359.
Evans et al., The in vitro ligation of bacterially expressed proteins using an intein from Methanobacterium thermoautotrophicum. J Biol Chem. Feb. 12, 1999;274(7):3923-6. doi: 10.1074/jbc.274.7.3923.
Evers et al., CRISPR knockout screening outperforms shRNA and CRISPRi in identifying essential genes. Nat Biotechnol. Jun. 2016;34(6):631-3. doi: 10.1038/nbt.3536. Epub Apr. 25, 2016.
Fagerlund et al., The Cpf1 CRISPR-Cas protein expands genome-editing tools. Genome Biology Nov. 17, 2015;16:251. https://doi.org/10.1186/s13059-015-0824-9.
Falnes et al., DNA repair by bacterial AlkB proteins. Res Microbiol. Oct. 2003;154(8):531-8. doi: 10.1016/S0923-2508(03)00150-5.
Falnes et al., Repair of methyl lesions in DNA and RNA by oxidative demethylation. Neuroscience. Apr. 14, 2007;145(4):1222-32. doi: 10.1016/j.neuroscience.2006.11.018. Epub Dec. 18, 2006.
Fang et al., Synthetic Studies Towards Halichondrins: Synthesis of the Left Halves of Norhalichondrins and Homohalichondrins. Tetrahedron Letters 1992;33(12):1557-1560.
Farhood et al., Codelivery to mammalian cells of a transcriptional factor with cis-acting element using cationic liposomes. Anal Biochem. Feb. 10, 1995;225(1):89-93.
Felletti et al., Twister Ribozymes as Highly Versatile Expression Platforms for Artificial Riboswitches. Nat Commun. Sep. 27, 2016;7:12834. doi: 10.1038/ncomms12834.
Feng et al., Crystal structures of the human RNA demethylase Alkbh5 reveal basis for substrate recognition. J Biol Chem. Apr. 25, 2014;289(17):11571-11583. doi: 10.1074/jbc.M113.546168. Epub Mar. 10, 2014.
Feng et al., Human L1 retrotransposon encodes a conserved endonuclease required for retrotransposition. Cell. Nov. 29, 1996;87(5):905-16. doi: 10.1016/s0092-8674(00)81997-2.

(56) References Cited

OTHER PUBLICATIONS

Ferretti et al., Complete genome sequence of an M1 strain of *Streptococcus pyogenes*. Proc Natl Acad Sci U S A. Apr. 10, 2001;98(8):4658-63.
Ferry et al., Rational design of inducible CRISPR guide RNAs for de novo assembly of transcriptional programs. Nat Commun. Mar. 3, 2017;8:14633. doi: 10.1038/ncomms14633.
Feuk, Inversion variants in the human genome: role in disease and genome architecture. Genome Med. Feb. 12, 2010;2(2):11. doi: 10.1186/gm132.
Fine et al., Trans-spliced Cas9 allows cleavage of HBB and CCR5 genes in human cells using compact expression cassettes. Scientific Reports 2015;5(1):Article No. 10777. doi:10.1038/srep10777. With Supplementary Information.
Fischer et al., Cryptic epitopes induce high-titer humoral immune response in patients with cancer. J Immunol. Sep. 1, 2010;185(5):3095-102. doi: 10.4049/jimmunol.0902166. Epub Jul. 26, 2010.
Fitzjohn, Diversitree: comparative phylogenetic analyses of diversification in R. Methods in Evology and Evolution. Dec. 2012;3(6):1084-92 .doi: 10.1111/j.2041-210X.2012.00234.x.
Flajolet et al., Woodchuck hepatitis virus enhancer I and enhancer II are both involved in N-myc2 activation in woodchuck liver tumors. J Virol. Jul. 1998;72(7):6175-80. doi: 10.1128/JVI.72.7.6175-6180.1998.
Flaman et al., A rapid PCR fidelity assay. Nucleic Acids Res. Aug. 11, 1994;22(15):3259-60. doi: 10.1093/nar/22.15.3259.
Fogg et al., New applications for phage integrases. J Mol Biol. Jul. 29, 2014;426(15):2703-16. doi: 10.1016/j.jmb.2014.05.014. Epub May 22, 2014.
Fogg et al., Genome Integration and Excision by a New Streptomyces Bacteriophage, ?Joe. Appl Environ Microbiol. Feb. 15, 2017;83(5):e02767-16. doi: 10.1128/AEM.02767-16.
Fonfara et al., Phylogeny of Cas9 determines functional exchangeability of dual-RNA and Cas9 among orthologous type II CRISPR-Cas systems. Nucleic Acids Res. Feb. 2014;42(4):2577-90. doi: 10.1093/nar/gkt1074. Epub Nov. 22, 2013.
Fouts et al., Sequencing Bacillus anthracis typing phages gamma and cherry reveals a common ancestry. J Bacteriol. May 2006;188(9):3402-8. doi: 10.1128/JB.188.9.3402-3408.2006.
Freitas et al., Mechanisms and signals for the nuclear import of proteins. Curr Genomics. Dec. 2009;10(8):550-7. doi: 10.2174/138920209789503941.
Freshney, Culture of Animal Cells. A Manual of Basic Technique. Alan R. Liss, Inc. New York. 1983;4.
Fu et al., Improving CRISPR-Cas nuclease specificity using truncated guide RNAs. Nat Biotechnol. Mar. 2014;32(3):279-84. doi: 10.1038/nbt.2808. Epub Jan. 26, 2014.
Fu et al., High-frequency off-target mutagenesis induced by CRISPR-Cas nucleases in human cells. Nat Biotechnol. Sep. 2013;31(9):822-6. doi: 10.1038/nbt.2623. Epub Jun. 23, 2013.
Fu et al., Promises and Pitfalls of Intracellular Delivery of Proteins. Bioconjugate Chemistry. Aug. 2014;25:1602-8.
Fuchs et al., Polyarginine as a multifunctional fusion tag. Protein Sci. Jun. 2005;14(6):1538-44.
Fujisawa et al., Disease-associated mutations in CIAS1 induce cathepsin B-dependent rapid cell death of human THP-1 monocytic cells. Blood. Apr. 1, 2007;109(7):2903-11.
Fukui et al., DNA Mismatch Repair in Eukaryotes and Bacteria. J Nucleic Acids. Jul. 27, 2010;2010. pii: 260512. doi: 10.4061/2010/260512.
Fung et al., Repair at single targeted DNA double-strand breaks in pluripotent and differentiated human cells. PLoS One. 2011;6(5):e20514. doi: 10.1371/journal.pone.0020514. Epub May 25, 2011.
Furukawa et al., In vitro selection of allosteric ribozymes that sense the bacterial second messenger c-di-GMP. Methods Mol Biol. 2014;1111:209-20. doi: 10.1007/978-1-62703-755-6_15.
Gaj et al., A comprehensive approach to zinc-finger recombinase customization enables genomic targeting in human cells. Nucleic Acids Res. Feb. 6, 2013;41(6):3937-46.
Gaj et al., Enhancing the specificity of recombinase-mediated genome engineering through dimer interface redesign. J Am Chem Soc. Apr. 2, 2014;136(13):5047-56. doi: 10.1021/ja4130059. Epub Mar. 20, 2014.
Gaj et al., Expanding the scope of site-specific recombinases for genetic and metabolic engineering. Biotechnol Bioeng. Jan. 2014;111(1):1-15. doi: 10.1002/bit.25096. Epub Sep. 13, 2013.
Gaj et al., ZFN, TALEN, and CRISPR/Cas-based methods for genome engineering. Trends Biotechnol. Jul. 2013;31(7):397-405. doi: 10.1016/j.tibtech.2013.04.004. Epub May 9, 2013.
Gajula, Designing an Elusive CoG?GoC CRISPR Base Editor. Trends Biochem Sci. Feb. 2019;44(2):91-94. doi: 10.1016/j.tibs.2018.10.004. Epub Nov. 13, 2018.
Gallo et al., A novel pathogenic PSEN1 mutation in a family with Alzheimer's disease: phenotypical and neuropathological features. J Alzheimers Dis. 2011;25(3):425-31. doi: 10.3233/JAD-2011-110185.
Gao et al., DNA-guided genome editing using the Natronobacterium gregoryi Argonaute. Nat Biotechnol. Jul. 2016;34(7):768-73. doi: 10.1038/nbt.3547. Epub May 2, 2016.
Gao et al., Treatment of autosomal dominant hearing loss by in vivo delivery of genome editing agents. Nature. Jan. 11, 2018;553(7687):217-221. doi: 10.1038/nature25164. Epub Dec. 20, 2017.
Garcia et al., Transglycosylation: a mechanism for RNA modification (and editing?). Bioorg Chem. Jun. 2005;33(3):229-51. doi: 10.1016/j.bioorg.2005.01.001. Epub Feb. 23, 2005.
Gardlik et al., Vectors and delivery systems in gene therapy. Med Sci Monit. Apr. 2005;11(4):RA110-21. Epub Mar. 24, 2005.
Garibyan et al., Use of the rpoB gene to determine the specificity of base substitution mutations in the *Escherichia coli* chromosome. DNA Repair (Amst). May 13, 2003;2(5):593-608.
Garneau et al., The CRISPR/Cas bacterial immune system cleaves bacteriophage and plasmid DNA. Nature. Nov. 4, 2010;468(7320):67-71. doi: 10.1038/nature09523.
Gasiunas et al., Cas9-crRNA ribonucleoprotein complex mediates specific DNA cleavage for adaptive immunity in bacteria. Proc Natl Acad Sci U S A. Sep. 25, 2012;109(39):E2579-86. Epub Sep. 4, 2012. Supplementary materials included.
Gasiunas et al., RNA-dependent DNA endonuclease Cas9 of the CRISPR system: Holy Grail of genome editing? Trends Microbiol. Nov. 2013;21(11):562-7. doi: 10.1016/j.tim.2013.09.001. Epub Oct. 1, 2013.
Gaudelli et al., Programmable base editing of AoT to GoC in genomic DNA without DNA cleavage. Nature. Nov. 23, 2017;551(7681):464-471. doi: 10.1038/nature24644. Epub Oct. 25, 2017. Erratum in: Nature. May 2, 2018.
Gehrke et al., An APOBEC3A-Cas9 base editor with minimized bystander and off-target activities. Nat Biotechnol. Nov. 2018;36(10):977-982. doi: 10.1038/nbt.4199. Epub Jul. 30, 2018.
GenBank Accession No. J01600.1. Brooks et al., *E. coli* dam gene coding for DNA adenine methylase. Apr. 26, 1993.
GenBank Accession No. U07651.1. Lu, *Escherichia coli* K12 negative regulator of replication initiation (seqA) gene, complete cds. Jul. 19, 1994.
Genbank Submission; NIH/NCBI, Accession No. AAA66622.1. Martinelli et al., May 18, 1995. 2 pages.
Genbank Submission; NIH/NCBI, Accession No. AGT42196. Farzadfar et al., Nov. 2, 2013. 2 pages.
Genbank Submission; NIH/NCBI, Accession No. APG80656.1. Burstein et al., Dec. 10, 2016. 1 pages.
Genbank Submission; NIH/NCBI, Accession No. AYD60528.1. Ram et al., Oct. 2, 2018. 1 page.
Genbank Submission; NIH/NCBI, Accession No. J04623. Kita et al., Apr. 26, 1993. 2 pages.
Genbank Submission; NIH/NCBI, Accession No. KR710351.1. Sahni et al., Jun. 1, 2015. 2 pages.
Genbank Submission; NIH/NCBI, Accession No. NC 002737.2. Nasser et al., Feb. 7, 2021. 2 pages.
Genbank Submission; NIH/NCBI, Accession No. NC_002737.1. Ferretti et al., Jun. 27, 2013. 1 page.
Genbank Submission; NIH/NCBI, Accession No. NC_015683.1. Trost et al., Jul. 6, 2013. 1 page.

(56) References Cited

OTHER PUBLICATIONS

Genbank Submission; NIH/NCBI, Accession No. NC_016782.1. Trost et al., Jun. 11, 2013. 1 page.
Genbank Submission; NIH/NCBI, Accession No. NC_016786.1. Trost et al., Aug. 28, 2013. 1 page.
Genbank Submission; NIH/NCBI, Accession No. NC_017053.1. Fittipaldi et al., Jul. 6, 2013. 1 page.
Genbank Submission; NIH/NCBI, Accession No. NC_017317.1. Trost et al., Jun. 11, 2013. 1 page.
Genbank Submission; NIH/NCBI, Accession No. NC_017861.1. Heidelberg et al., Jun. 11, 2013. 1 page.
Genbank Submission; NIH/NCBI, Accession No. NC_018010.1. Lucas et al., Jun. 11, 2013. 2 pages.
Genbank Submission; NIH/NCBI, Accession No. NC_018721.1. Feng et al., Jun. 11, 2013. 1 pages.
Genbank Submission; NIH/NCBI, Accession No. NC_021284.1. Ku et al., Jul. 12, 2013. 1 page.
Genbank Submission; NIH/NCBI, Accession No. NC_021314.1. Zhang et al., Jul. 15, 2013. 1 page.
Genbank Submission; NIH/NCBI, Accession No. NC_021846.1. Lo et al., Jul. 22, 2013. 1 page.
Genbank Submission; NIH/NCBI, Accession No. NM_000311.5. Alves et al., Mar. 7, 2021. 5 pages.
Genbank Submission; NIH/NCBI, Accession No. NM_001319224. Umar et al., Apr. 21, 2021. 7 pages.
Genbank Submission; NIH/NCBI, Accession No. NM_003686. Umar et al., Apr. 9, 2021. 7 pages.
Genbank Submission; NIH/NCBI, Accession No. NM_006027. Umar et al., Apr. 10, 2021. 7 pages.
Genbank Submission; NIH/NCBI, Accession No. NM_002427.3. Wu et al., May 3, 2014. 5 pages.
Genbank Submission; NIH/NCBI, Accession No. NM_174936. Bernardini et al. Oct. 28, 2015. 6 pages.
Genbank Submission; NIH/NCBI, Accession No. NP_000302.1. Alves et al., Mar. 7, 2021. 4 pages.
Genbank Submission; NIH/NCBI, Accession No. NP_472073.1. Glaser et al., Jun. 27, 2013. 2 pages.
Genbank Submission; NIH/NCBI, Accession No. NP_955579.1. Chen et al., Aug. 13, 2018. 5 pages.
Genbank Submission; NIH/NCBI, Accession No. P42212. Prasher et al., Mar. 19, 2014. 7 pages.
Genbank Submission; NIH/NCBI, Accession No. QBJ66766. Duan et al. Aug. 12, 2020. 2 pages.
Genbank Submission; NIH/NCBI, Accession No. RFF81513.1. Zhou et al., Aug. 21, 2018. 2 pages.
Genbank Submission; NIH/NCBI, Accession No. SNX31424.1. Weckx, S., Feb. 16, 2018. 2 pages.
Genbank Submission; NIH/NCBI, Accession No. TGH57013. Xu et al., Apr. 9, 2019. 2 pages.
Genbank Submission; NIH/NCBI, Accession No. WP_016631044.1. Haft et al., Sep. 22, 2020. 1 page.
Genbank Submission; NIH/NCBI, Accession No. WP_031386437. No Author Listed., Sep. 23, 2019. 1 page.
Genbank Submission; NIH/NCBI, Accession No. WP_031589969.1. Haft et al., Oct. 9, 2019. 2 pages.
Genbank Submission; NIH/NCBI, Accession No. WP_044924278.1. Haft et al., Oct. 9, 2019. 2 pages.
Genbank Submission; NIH/NCBI, Accession No. WP_047338501.1. Haft et al., Oct. 9, 2019. 2 pages.
Genbank Submission; NIH/NCBI, Accession No. WP_060798984.1. Haft et al., Oct. 9, 2019. 2 pages.
Genbank Submission; NIH/NCBI, Accession No. WP_062913273.1. Haft et al., Oct. 9, 2019. 2 pages.
Genbank Submission; NIH/NCBI, Accession No. WP_072754838. No Author Listed., Sep. 23, 2019. 1 page.
Genbank Submission; NIH/NCBI, Accession No. WP_095142515.1. No Author Listed., Sep. 23, 2019. 1 page.
Genbank Submission; NIH/NCBI, Accession No. WP_118538418.1. No Author Listed., Oct. 13, 2019. 1 page.
Genbank Submission; NIH/NCBI, Accession No. WP_119223642.1. No Author Listed., Oct. 13, 2019. 1 page.
Genbank Submission; NIH/NCBI, Accession No. WP_119227726.1. No Author Listed., Oct. 13, 2019. 1 page.
Genbank Submission; NIH/NCBI, Accession No. WP_119623382.1. No Author Listed., Oct. 13, 2019. 1 page.
Genbank Submission; NIH/NCBI, Accession No. WP_132221894.1. No Author Listed., Sep. 23, 2019. 1 page.
Genbank Submission; NIH/NCBI, Accession No. WP_133478044.1. Haft et al., Oct. 9, 2019. 2 pages.
Genbank Submission; NIH/NCBI, Accession No. YP_002342100.1. Bernardini et al., Jun. 10, 2013. 2 pages.
Genbank Submission; NIH/NCBI, Accession No. YP_002344900.1. Gundogdu et al., Mar. 19, 2014. 2 pages.
Genbank Submission; NIH/NCBI, Accession No. YP_009283008.1. Bernardini et al., Sep. 23, 2016. 2 pages.
Genbank Submission; NIH/NCBI, Accession No. YP_820832.1. Makarova et al., Aug. 27, 2013. 2 pages.
George et al., Adenosine deaminases acting on RNA, RNA editing, and interferon action. J Interferon Cytokine Res. Jan. 2011;31(1):99-117. doi: 10.1089/jir.2010.0097. Epub Dec. 23, 2010. PMID: 21182352; PMCID: PMC3034097.
Gerard et al., Purification and characterization of the DNA polymerase and RNase H activities in Moloney murine sarcoma-leukemia virus. J Virol. Apr. 1975;15(4):785-97. doi: 10.1128/JVI.15.4.785-797.1975.
Gerard et al., The role of template-primer in protection of reverse transcriptase from thermal inactivation. Nucleic Acids Res. Jul. 15, 2002;30(14):3118-29. doi: 10.1093/nar/gkf417.
Gerber et al., An adenosine deaminase that generates inosine at the wobble position of tRNAs. Science. Nov. 5, 1999;286(5442):1146-9. doi: 10.1126/science.286.5442.1146.
Gerber et al., RNA editing by base deamination: more enzymes, more targets, new mysteries. Trends Biochem Sci. Jun. 2001;26(6):376-84.
Gersbach et al., Directed evolution of recombinase specificity by split gene reassembly. Nucleic Acids Res. Jul. 2010;38(12):4198-206. doi: 10.1093/nar/gkq125. Epub Mar. 1, 2010.
Gersbach et al., Targeted plasmid integration into the human genome by an engineered zinc-finger recombinase. Nucleic Acids Res. Sep. 1, 2011;39(17):7868-78. doi: 10.1093/nar/gkr421. Epub Jun. 7, 2011.
Ghahfarokhi et al., Blastocyst Formation Rate and Transgene Expression are Associated with Gene Insertion into Safe and Non-Safe Harbors in the Cattle Genome. Sci Rep. Nov. 13, 2017;7(1):15432. doi: 10.1038/s41598-017-15648-3.
Gilbert et al., CRISPR-mediated modular RNA-guided regulation of transcription in eukaryotes. Cell. 2013 154(2):442-51.
Gilleron et al., Image-based analysis of lipid nanoparticle-mediated siRNA delivery, intracellular trafficking and endosomal escape. Nat Biotechnol. Jul. 2013;31(7):638-46. doi: 10.1038/nbt.2612. Epub Jun. 23, 2013.
Glasgow et al., DNA-binding properties of the Hin recombinase. J Biol Chem. Jun. 15, 1989;264(17):10072-82.
Glassner et al., Generation of a strong mutator phenotype in yeast by imbalanced base excision repair. Proc Natl Acad Sci U S A. Aug. 18, 1998;95(17):9997-10002.
Goldberg et al., Epigenetics: a landscape takes shape. Cell. Feb. 23, 2007;128(4):635-8. doi: 10.1016/j.cell.2007.02.006.
Gong et al., Active DNA demethylation by oxidation and repair. Cell Res. Dec. 2011;21(12):1649-51. doi: 10.1038/cr.2011.140. Epub Aug. 23, 2011.
Gonzalez et al., An iCRISPR platform for rapid, multiplexable, and inducible genome editing in human pluripotent stem cells. Cell Stem Cell. Aug. 7, 2014;15(2):215-26. doi: 10.1016/j.stem.2014.05.018. Epub Jun. 12, 2014.
Goodnough et al., Development of a delivery vehicle for intracellular transport of botulinum neurotoxin antagonists. FEBS Lett. Feb. 27, 2002;513(2-3):163-8.
Grainge et al., The integrase family of recombinase: organization and function of the active site. Mol Microbiol. Aug. 1999;33(3):449-56.

(56) References Cited

OTHER PUBLICATIONS

Gregory et al., Integration site for Streptomyces phage phiBT1 and development of site-specific integrating vectors. J Bacteriol. Sep. 2003;185(17):5320-3. doi: 10.1128/jb.185.17.5320-5323.2003.
Griffiths, Endogenous retroviruses in the human genome sequence. Genome Biol. 2001;2(6):REVIEWS1017. doi: 10.1186/gb-2001-2-6-reviews1017. Epub Jun. 5, 2001.
Grishok et al., Genes and Mechanisms Related to RNA Interference Regulate Expression of the Small Temporal RNAs that Control C. elegans Developmental Timing. Jul. 13, 2001:106(1):P23-4.
Groth et al., Construction of transgenic *Drosophila* by using the site-specific integrase from phage phiC31. Genetics. Apr. 2004;166(4):1775-82. doi: 10.1534/genetics.166.4.1775.
Gruber et al., Strategies for measuring evolutionary conservation of RNA secondary structures. BMC Bioinformatics. Feb. 26, 2008;9:122. doi: 10.1186/1471-2105-9-122.
Grunebaum et al., Recent advances in understanding and managing adenosine deaminase and purine nucleoside phosphorylase deficiencies. Curr Opin Allergy Clin Immunol. Dec. 2013;13(6):630-8. doi: 10.1097/ACI.0000000000000006.
Grünewald et al., Transcriptome-wide off-target RNA editing induced by CRISPR-guided DNA base editors. Nature. May 2019;569(7756):433-437. doi: 10.1038/s41586-019-1161-z. Epub Apr. 17, 2019.
Guilinger et al., Broad specificity profiling of TALENs results in engineered nucleases with improved DNA-cleavage specificity. Nat Methods. Apr. 2014;11(4):429-35. doi: 10.1038/nmeth.2845. Epub Feb. 16, 2014.
Guilinger et al., Fusion of catalytically inactive Cas9 to FokI nuclease improves the specificity of genome modification. Nat Biotechnol. Jun. 2014;32(6):577-82. doi: 10.1038/nbt.2909. Epub Apr. 25, 2014.and supplemental pages.
Guo et al., Protein tolerance to random amino acid change. Proc Natl Acad Sci U S A. Jun. 22, 2004;101(25):9205-10. Epub Jun. 14, 2004.
Gupta et al., Sequences in attB that affect the ability of phiC31 integrase to synapse and to activate DNA cleavage. Nucleic Acids Res. 2007;35(10):3407-19. doi: 10.1093/nar/gkm206. Epub May 3, 2007.
Guzman et al., Tight regulation, modulation, and high-level expression by vectors containing the arabinose PBAD promoter. J Bacteriol. 1995;177(14):4121-4130.
Haeussler et al., Evaluation of off-target and on-target scoring algorithms and integration into the guide RNA selection tool CRISPOR. Genome Biol. Jul. 5, 2016;17(1):148. doi: 10.1186/s13059-016-1012-2.
Hale et al., RNA-guided RNA cleavage by a CRISPR RNA-Cas protein complex. Cell. Nov. 25, 2009;139(5):945-56. doi: 10.1016/j.cell.2009.07.040.
Halmai et al., Targeted CRIPSR/dCas9-mediated reactivation of epigenetically silenced genes suggests limited escape from the inactive X chromosome. 2nd Intl Conf on Epigenetics and Bioengineering. Oct. 4, 2018; Retrieved from the Internet: https://aiche.confex.com/aiche/epibiol8/webprogram/paper544785.html. Retrieved Jun. 29, 2020.
Halperin et al., CRISPR-guided DNA polymerases enable diversification of all nucleotides in a tunable window. Nature. Aug. 2018;560(7717):248-252. doi: 10.1038/s41586-018-0384-8. Epub Aug. 1, 2018.
Halvas et al., Role of murine leukemia virus reverse transcriptase deoxyribonucleoside triphosphate-binding site in retroviral replication and in vivo fidelity. J Virol. Nov. 2000;74(22):10349-58. doi: 10.1128/jvi.74.22.10349-10358.2000.
Hamano-Takaku et al., A mutant *Escherichia coli* tyrosyl-tRNA synthetase utilizes the unnatural amino acid azatyrosine more efficiently than tyrosine. J Biol Chem. Dec. 22, 2000;275(51):40324-8.
Han, New CRISPR/Cas9-based Tech Edits Single Nucleotides Without Breaking DNA. Genome Web, Apr. 20, 2016. https://www.genomeweb.com/gene-silencinggene-editing/new-crisprcas9-based-tech-edits-single-nucleotides-without-breaking-dna.
Handa et al., Template-assisted synthesis of adenine-mutagenized cDNA by a retroelement protein complex. Nucleic Acids Res. Oct. 12, 2018;46(18):9711-9725. doi: 10.1093/nar/gky620.
Hanson et al., Codon optimality, bias and usage in translation and mRNA decay. Nat Rev Mol Cell Biol. Jan. 2018;19(1):20-30. doi: 10.1038/nrm.2017.91. Epub Oct. 11, 2017.
Harms et al., Evolutionary biochemistry: revealing the historical and physical causes of protein properties. Nat Rev Genet. Aug. 2013;14(8):559-71. doi: 10.1038/nrg3540.
Harrington et al., A thermostable Cas9 with increased lifetime in human plasma. Nat Commun. Nov. 10, 2017;8(1):1424. doi: 10.1038/s41467-017-01408-4.
Harris et al., RNA Editing Enzyme APOBEC1 and Some of Its Homologs Can Act as DNA Mutators. Mol Cell. Nov. 2002;10(5):1247-53.
Hartung et al., Correction of metabolic, craniofacial, and neurologic abnormalities in MPS I mice treated at birth with adeno-associated virus vector transducing the human alpha-L-iduronidase gene. Mol Ther. Jun. 2004;9(6):866-75.
Hasadsri et al., Functional protein delivery into neurons using polymeric nanoparticles. J Biol Chem. Mar. 13, 2009;284(11):6972-81. doi: 10.1074/jbc.M805956200. Epub Jan. 7, 2009.
Hasegawa et al., Spontaneous mutagenesis associated with nucleotide excision repair in *Escherichia coli*. Genes Cells. May 2008;13(5):459-69. doi: 10.1111/j.1365-2443.2008.01185.x.
Hayes et al., Stop codons preceded by rare arginine codons are efficient determinants of SsrA tagging in *Escherichia coli*. Proc Natl Acad Sci U S A. Mar. 19, 2002;99(6):3440-5. Epub Mar. 12, 2002.
Heidenreich et al., Non-homologous end joining as an important mutagenic process in cell cycle-arrested cells. EMBO J. May 1, 2003;22(9):2274-83. doi: 10.1093/emboj/cdg203.
Held et al., In vivo correction of murine hereditary tyrosinemia type I by phiC31 integrase-mediated gene delivery. Mol Ther. Mar. 2005;11(3):399-408. doi: 10.1016/j.ymthe.2004.11.001.
Heller et al., Replisome assembly and the direct restart of stalled replication forks. Nat Rev Mol Cell Biol. Dec. 2006;7(12):932-43. Epub Nov. 8, 2006.
Hendricks et al., The S. cerevisiae Mag1 3-methyladenine DNA glycosylase modulates susceptibility to homologous recombination. DNA Repair (Amst). 2002;1(8):645-659.
Hermonat et al., Use of adeno-associated virus as a mammalian DNA cloning vector: transduction of neomycin resistance into mammalian tissue culture cells. Proc Natl Acad Sci U S A. Oct. 1984;81(20):6466-70. doi: 10.1073/pnas.81.20.6466.
Herzig et al., A Novel Leu92 Mutant of HIV-1 Reverse Transcriptase with a Selective Deficiency in Strand Transfer Causes a Loss of Viral Replication. J Virol. Aug. 2015;89(16):8119-29. doi: 10.1128/JVI.00809-15. Epub May 20, 2015.
Hess et al., Directed evolution using dCas9-targeted somatic hypermutation in mammalian cells. Nat Methods. Dec. 2016;13(12):1036-1042. doi: 10.1038/nmeth.4038. Epub Oct. 31, 2016.
Hickford et al., Antitumour polyether macrolides: four new halichondrins from the New Zealand deep-water marine sponge *Lissodendoryx* sp. Bioorg Med Chem. Mar. 15, 2009;17(6):2199-203. doi: 10.1016/j.bmc.2008.10.093. Epub Nov. 19, 2008.
Hida et al., Directed evolution for drug and nucleic acid; delivery. Adv Drug Deliv Rev. Dec. 22, 2007;59(15):1562-78. Epub Aug. 28, 2007.; Review.
Hill et al., Functional analysis of conserved histidines in ADP-glucose pyrophosphorylase from *Escherichia coli*.Biochem Biophys Res Commun. Mar. 17, 1998;244(2):573-7.
Hille et al., The Biology of CRISPR-Cas: Backward and Forward. Cell. Mar. 8, 2018;172(6):1239-1259. doi: 10.1016/j.cell.2017.11.032.
Hilton et al., Enabling functional genomics with genome engineering. Genome Res. Oct. 2015;25(10):1442-55. doi: 10.1101/gr.190124.115.
Hirano et al., Structural Basis for the Altered PAM Specificities of Engineered CRISPR-Cas9. Mol Cell. Mar. 17, 2016;61(6):886-94. doi: 10.1016/j.molcel.2016.02.018.

(56) References Cited

OTHER PUBLICATIONS

Hoang et al., UFBoot2: Improving the Ultrafast Bootstrap Approximation. Mol Biol Evol. Feb. 1, 2018;35(2):518-522. doi: 10.1093/molbev/msx281.
Hockemeyer et al., Efficient targeting of expressed and silent genes in human ESCs and iPSCs using zinc-finger nucleases. Nat Biotechnol. Sep. 2009;27(9):851-7. doi: 10.1038/nbt.1562. Epub Aug. 13, 2009.
Hockemeyer et al., Genetic engineering of human pluripotent cells using TALE nucleases. Nat Biotechnol. Jul. 7, 2011;29(8):731-4. doi: 10.1038/nbt.1927.
Hoernes et al., Translating the epitranscriptome. Wiley Interdiscip Rev RNA. Jan. 2017;8(1):e1375. doi: 10.1002/wrna.1375. Epub Jun. 27, 2016.
Holden et al., Crystal structure of the anti-viral APOBEC3G catalytic domain and functional implications. Nature. Nov. 6, 2008;456(7218):121-4. doi: 10.1038/nature07357. Epub Oct. 12, 2008.
Hollis et al., Phage integrases for the construction and manipulation of transgenic mammals. Reprod Biol Endocrinol. Nov. 7, 2003;1:79. doi: 10.1186/1477-7827-1-79.
Holsinger et al., Signal transduction in T lymphocytes using a conditional allele of Sos. Proc Natl Acad Sci U S A. Oct. 10, 1995;92(21):9810-4. doi: 10.1073/pnas.92.21.9810.
Hondares et al., Peroxisome Proliferator-activated Receptor ? (PPAR?) Induces PPAR? Coactivator 1? (PGC-1?) Gene Expression and Contributes to Thermogenic Activation of Brown Fat. J Biol. Chem Oct. 2011; 286(50):43112-22. doi: 10.1074/jbc.M111.252775.
Hoogenboom et al., Natural and designer binding sites made by phage display technology. Immunol Today. Aug. 2000;21(8):371-8.
Horvath et al., CRISPR/Cas, the immune system of bacteria and archaea. Science. Jan. 8, 2010;327(5962):167-70. doi: 10.1126/science.1179555.
Horvath et al., Diversity, Activity, and Evolution of CRISPR Loci in *Streptococcus thermophilus*. J Bacteriol. Feb. 2008;190(4):1401-12. doi: 10.1128/JB.01415-07. Epub Dec. 7, 2007.
Hou et al., Efficient genome engineering in human pluripotent stem cells using Cas9 from Neisseria meningitidis. Proc Natl Acad Sci U S A. Sep. 24, 2013;110(39):15644-9. doi: 10.1073/pnas.1313587110. Epub Aug. 12, 2013.
Houdebine, The methods to generate transgenic animals and to control transgene expression. J Biotechnol. Sep. 25, 2002;98(2-3):145-60.
Howard et al., Intracerebral drug delivery in rats with lesion-induced memory deficits. J Neurosurg. Jul. 1989;71(1):105-12.
Hower et al., Shape-based peak identification for ChIP-Seq. BMC Bioinformatics. Jan. 12, 2011;12:15. doi: 10.1186/1471-2105-12-15.
Hsu et al., DNA targeting specificity of RNA-guided Cas9 nucleases. Nat Biotechnol. Sep. 2013;31(9):827-32. doi: 10.1038/nbt.2647. Epub Jul. 21, 2013.
Hu et al., Chemical Biology Approaches to Genome Editing: Understanding, Controlling, and Delivering Programmable Nucleases. Cell Chem Biol. Jan. 21, 2016;23(1):57-73. doi: 10.1016/j.chembiol.2015.12.009.
Hu et al., Evolved Cas9 variants with broad PAM compatibility and high DNA specificity. Nature. Apr. 5, 2018;556(7699):57-63. doi: 10.1038/nature26155. Epub Feb. 28, 2018.
Huang et al., Circularly permuted and PAM-modified Cas9 variants broaden the targeting scope of base editors. Nat Biotechnol. Jun. 2019;37(6):626-631. doi: 10.1038/s41587-019-0134-y. Epub May 20, 2019. Including Supplementary Information.
Huang et al., Heritable gene targeting in zebrafish using customized TALENs. Nat Biotechnol. Aug. 5, 2011;29(8):699-700. doi: 10.1038/nbt.1939.
Humbert et al., Targeted gene therapies: tools, applications, optimization. Crit Rev Biochem Mol Biol. May-Jun. 2012;47(3):264-81. doi: 10.3109/10409238.2012.658112.
Hung et al., Protein localization in disease and therapy. J Cell Sci. Oct. 15, 2011;124(Pt 20):3381-92. doi: 10.1242/jcs.089110.
Hurt et al., Highly specific zinc finger proteins obtained by directed domain shuffling and cell-based selection. Proc Natl Acad Sci U S A. Oct. 14, 2003;100(21):12271-6. Epub Oct. 3, 2003.
Husimi, Selection and evolution of bacteriophages in cellstat. Adv Biophys. ; 1989;25:1-43. Review.
Hwang et al., Efficient genome editing in zebrafish using a CRISPR-Cas system. Nat Biotechnol. Mar. 2013;31(3):227-9. doi: 10.1038/nbt.2501. Epub Jan. 29, 2013.
Hwang et al., Efficient In Vivo Genome Editing Using RNA-Guided Nucleases. Nat Biotechnol. Mar. 2013;31(3): 227-229. doi: 10.1038/nbt.2501. Epub Jan. 29, 2013.
Hwang et al., Web-based design and analysis tools for CRISPR base editing. BMC Bioinformatics. Dec. 27, 2018;19(1):542. doi: 10.1186/s12859-018-2585-4.
Iida et al., A site-specific, conservative recombination system carried by bacteriophage P1. Mapping the recombinase gene cin and the cross-over sites cix for the inversion of the C segment. EMBO J. 1982;1(11):1445-53.
Ikediobi et al., Mutation analysis of 24 known cancer genes in the NCI-60 cell line set. Mol Cancer Ther. Nov. 2006;5(11):2606-12. Epub Nov. 6, 2006.
Imburgio et al., Studies of promoter recognition and start site selection by T7 RNA polymerase using a comprehensive collection of promoter variants. Biochemistry. Aug. 29, 2000;39(34):10419-30.
Irrthum et al., Congenital hereditary lymphedema caused by a mutation that inactivates VEGFR3 tyrosine kinase. Am J Hum Genet. Aug. 2000;67(2):295-301. Epub Jun. 9, 2000.
Ishino et al., Nucleotide sequence of the iap gene, responsible for alkaline phosphatase isozyme conversion in *Escherichia coli*, and identification of the gene product. J Bacteriol. Dec. 1987;169(12):5429-33.
Iwai et al., Circular beta-lactamase: stability enhancement by cyclizing the backbone. FEBS Lett. Oct. 8, 1999;459(2):166-72. doi: 10.1016/s0014-5793(99)01220-x.
Iwai et al., Highly efficient protein trans-splicing by a naturally split DnaE intein from Nostoc punctiforme. FEBS Lett. Mar. 20, 2006;580(7):1853-8. doi: 10.1016/j.febslet.2006.02.045. Epub Feb. 24, 2006.
Jaffrey et al., Emerging links between m6A and misregulated mRNA methylation in cancer. Genome Med. Jan. 12, 2017;9(1):2. doi: 10.1186/s13073-016-0395-8.
Jamieson et al., Drug discovery with engineered zinc-finger proteins. Nat Rev Drug Discov. May 2003;2(5):361-8.
Jansen et al., Backbone and nucleobase contacts to glucosamine-6-phosphate in the glmS ribozyme. Nat Struct Mol Biol. Jun. 2006;13(6):517-23. Epub May 14, 2006.
Jansen et al., Identification of genes that are associated with DNA repeats in prokaryotes. Mol Microbiol. Mar. 2002;43(6):1565-75.
Jasin et al., Repair of strand breaks by homologous recombination. Cold Spring Harb Perspect Biol. Nov. 1, 2013;5(11):a012740. doi: 10.1101/cshperspect.a012740.
Jemielity et al., Novel "anti-reverse" cap analogs with superior translational properties. RNA. Sep. 2003;9(9):1108-22. doi: 10.1261/rna.5430403.
Jenkins et al., Comparison of a preQ1 riboswitch aptamer in metabolite-bound and free states with implications for gene regulation. J Biol Chem. Jul. 15, 2011;286(28):24626-37. doi: 10.1074/jbc.M111.230375. Epub May 18, 2011.
Jiang et al., CRISPR-Cas9 Structures and Mechanisms. Annu Rev Biophys. May 22, 2017;46:505-529. doi: 10.1146/annurev-biophys-062215-010822. Epub Mar. 30, 2017.
Jiang et al., RNA-guided editing of bacterial genomes using CRISPR-Cas systems. Nat Biotechnol. Mar. 2013;31(3):233-9. doi: 10.1038/nbt.2508. Epub Jan. 29, 2013.
Jiang et al., Structural Biology. A Cas9-guide RNA Complex Preorganized for Target DNA Recognition. Science. Jun. 26, 2015;348(6242):1477-81. doi: 10.1126/science.aab1452.
Jiang et al., Structures of a CRISPR-Cas9 R-loop complex primed for DNA cleavage. Science. Feb. 19, 2016;351(6275):867-71. doi: 10.1126/science.aad8282. Epub Jan. 14, 2016.

(56) References Cited

OTHER PUBLICATIONS

Jinek et al., A programmable dual-RNA-guided DNA endonuclease in adaptive bacterial immunity. Science. Aug. 17, 2012;337(6096):816-21. doi: 10.1126/science.1225829. Epub Jun. 28, 2012.
Jinek et al., RNA-programmed genome editing in human cells. Elife. Jan. 29, 2013;2:e00471. doi: 10.7554/eLife.00471.
Jinek et al., Structures of Cas9 endonucleases reveal RNA-mediated conformational activation. Science. Mar. 14, 2014;343(6176):1247997. doi: 10.1126/science.1247997. Epub Feb. 6, 2014.
Johann et al., GLVR1, a receptor for gibbon ape leukemia virus, is homologous to a phosphate permease of Neurospora crassa and is expressed at high levels in the brain and thymus. J Virol. Mar. 1992;66(3):1635-40. doi: 10.1128/JVI.66.3.1635-1640.1992.
Johns et al., The promise and peril of continuous in vitro evolution. J Mol Evol. Aug. 2005;61(2):253-63. Epub Jun. 27, 2005.
Joho et al., Identification of a region of the bacteriophage T3 and T7 RNA polymerases that determines promoter specificity. J Mol Biol. Sep. 5, 1990;215(1):31-9.
Jore et al., Structural basis for CRISPR RNA-guided DNA recognition by Cascade. Nat Struct Mol Biol. May 2011;18(5):529-36. doi: 10.1038/nsmb.2019. Epub Apr. 3, 2011.
Joung et al.,TALENs: a widely applicable technology for targeted genome editing. Nat Rev Mol Cell Biol. Jan. 2013;14(1):49-55. doi: 10.1038/nrm3486. Epub Nov. 21, 2012.
Joyce et al., Amplification, mutation and selection of catalytic RNA. Gene. Oct. 15, 1989;82(1):83-7. doi: 10.1016/0378-1119(89)90033-4.
Kaczmarczyk et al., Manipulating the Prion Protein Gene Sequence and Expression Levels with CRISPR/Cas9. PLoS One. Apr. 29, 2016;11(4):e0154604. doi: 10.1371/journal.pone.0154604.
Kadoch et al., Reversible disruption of mSWI/SNF (BAF) complexes by the SS18-SSX oncogenic fusion in synovial sarcoma. Cell. Mar. 28, 2013;153(1):71-85. doi: 10.1016/j.cell.2013.02.036.
Kahmann et al., G inversion in bacteriophage Mu DNA is stimulated by a site within the invertase gene and a host factor. Cell. Jul. 1985;41(3):771-80. doi: 10.1016/s0092-8674(85)80058-1.
Kaiser et al., Gene therapy. Putting the fingers on gene repair. Science. Dec. 23, 2005;310(5756):1894-6.
Kakiyama et al., A peptide release system using a photo-cleavable linker in a cell array format for cell-toxicity analysis. Polymer J. Feb. 27, 2013;45:535-9.
Kalyaanamoorthy et al., ModelFinder: fast model selection for accurate phylogenetic estimates. Nat Methods. Jun. 2017;14(6):587-589. doi: 10.1038/nmeth.4285. Epub May 8, 2017.
Kandavelou et al., Targeted manipulation of mammalian genomes using designed zinc finger nucleases. Biochem Biophys Res Commun. Oct. 9, 2009;388(1):56-61. doi: 10.1016/j.bbrc.2009.07.112. Epub Jul. 25, 2009.
Kang et al., Structural Insights into riboswitch control of the biosynthesis of queuosine, a modified nucleotide found in the anticodon of tRNA. Mol Cell. Mar. 27, 2009;33(6):784-90. doi: 10.1016/j.molcel.2009.02.019. Epub Mar. 12, 2009.
Kappel et al., Regulating gene expression in transgenic animals. Curr Opin Biotechnol. Oct. 1992;3(5):548-53.
Karimova et al., Discovery of Nigri/nox and Panto/pox site-specific recombinase systems facilitates advanced genome engineering. Sci Rep. Jul. 22, 2016;6:30130. doi: 10.1038/srep30130.
Karimova et al., Vika/vox, a novel efficient and specific Cre/loxP-like site-specific recombination system. Nucleic Acids Res. Jan. 2013;41(2):e37. doi: 10.1093/nar/gks1037. Epub Nov. 9, 2012.
Karpenshif et al., From yeast to mammals: recent advances in genetic control of homologous recombination. DNA Repair (Amst). Oct. 1, 2012;11(10):781-8. doi: 10.1016/j.dnarep.2012.07.001. Epub Aug. 11, 2012. Review.
Karpinsky et al., Directed evolution of a recombinase that excises the provirus of most HIV-1 primary isolates with high specificity. Nat Biotechnol. Apr. 2016;34(4):401-9. doi: 10.1038/nbt.3467. Epub Feb. 22, 2016.
Katoh et al., MAFFT multiple sequence alignment software version 7: improvements in performance and usability. Mol Biol Evol. Apr. 2013;30(4):772-80. doi: 10.1093/molbev/mst010. Epub Jan. 16, 2013.
Kaufman et al., Translational efficiency of polycistronic mRNAs and their utilization to express heterologous genes in mammalian cells. EMBO J. Jan. 1987;6(1):187-93.
Kawarasaki et al., Enhanced crossover SCRATCHY: construction and high-throughput screening of a combinatorial library containing multiple non-homologous crossovers. Nucleic Acids Res. Nov. 1, 2003;31(21):e126.
Kaya et al., A bacterial Argonaute with noncanonical guide RNA specificity. Proc. Natl. Acad. Sci. USA Apr. 2016;113(15):4057-62.
Keijzers et al., Human exonuclease 1 (EXO1) activity characterization and its function on flap structures. Biosci Rep. Apr. 25, 2015;35(3):e00206. doi: 10.1042/BSR20150058.
Kellendonk et al., Regulation of Cre recombinase activity by the synthetic steroid RU 486. Nucleic Acids Res. Apr. 15, 1996;24(8):1404-11.
Kelman, PCNA: structure, functions and interactions. Oncogene. Feb. 13, 1997;14(6):629-40. doi: 10.1038/sj.onc.1200886.
Kessler et al., Gene delivery to skeletal muscle results in sustained expression and systemic delivery of a therapeutic protein. Proc Natl Acad Sci U S A. Nov. 26, 1996;93(24):14082-7. doi: 10.1073/pnas.93.24.14082.
Kiga et al., An engineered *Escherichia coli* tyrosyl-tRNA synthetase for site-specific incorporation of an unnatural amino acid into proteins in eukaryotic translation and its application in a wheat germ cell-free system. Proc Natl Acad Sci U S A. Jul. 23, 2002;99(15):9715-20. Epub Jul. 3, 2002.
Kilcher et al., Brochothrix thermosphacta bacteriophages feature heterogeneous and highly mosaic genomes and utilize unique prophage insertion sites. J Bacteriol. Oct. 2010;192(20):5441-53. doi: 10.1128/JB.00709-10. Epub Aug. 13, 2010.
Kim et al., DJ-1, a novel regulator of the tumor suppressor PTEN. Cancer Cell. 2005;7(3):263-273.
Kim et al., A library of TAL effector nucleases spanning the human genome. Nat Biotechnol. Mar. 2013;31(3):251-8. Doi: 10.1038/nbt.2517. Epub Feb. 17, 2013.
Kim et al., Genome-wide target specificities of CRISPR RNA-guided programmable deaminases. Nat Biotechnol. May 2017;35(5):475-480. doi: 10.1038/nbt.3852. Epub Apr. 10, 2017.
Kim et al., High cleavage efficiency of a 2A peptide derived from porcine teschovirus-1 in human cell lines, zebrafish and mice. PLoS One. 2011;6(4):e18556. doi: 10.1371/journal.pone.0018556. Epub Apr. 29, 2011.
Kim et al., Highly efficient RNA-guided base editing in mouse embryos. Nat Biotechnol. May 2017;35(5):435-437. doi: 10.1038/nbt.3816. Epub Feb. 27, 2017.
Kim et al., Highly efficient RNA-guided genome editing in human cells via delivery of purified Cas9 ribonucleoproteins. Genome Res. Jun. 2014;24(6):1012-9. doi: 10.1101/gr.171322.113. Epub Apr. 2, 2014.
Kim et al., Hybrid restriction enzymes: zinc finger fusions to Fok I cleavage domain. Proc Natl Acad Sci U S A. Feb. 6, 1996;93(3):1156-60. doi: 10.1073/pnas.93.3.1156.
Kim et al., In vivo high-throughput profiling of CRISPR-Cpf1 activity. Nat Methods. Feb. 2017;14(2):153-159. doi: 10.1038/nmeth.4104. Epub Dec. 19, 2016.
Kim et al., Increasing the genome-targeting scope and precision of base editing with engineered Cas9-cytidine deaminase fusions. Nat Biotechnol. Apr. 2017;35(4):371-376. doi: 10.1038/nbt.3803. Epub Feb. 13, 2017.
Kim et al., Mycobacteriophage Bxb1 integrates into the *Mycobacterium smegmatis* groEL1 gene. Mol Microbiol. Oct. 2003;50(2):463-73. doi: 10.1046/j.1365-2958.2003.03723.x.
Kim et al., Rescue of high-specificity Cas9 variants using sgRNAs with matched 5' nucleotides. Genome Biol. Nov. 15, 2017;18(1):218. doi: 10.1186/s13059-017-1355-3.
Kim et al., Structural and kinetic characterization of *Escherichia coli* TadA, the wobble-specific tRNA deaminase. Biochemistry. May 23, 2006;45(20):6407-16. doi: 10.1021/bi0522394. PMID: 16700551.

(56) References Cited

OTHER PUBLICATIONS

Kim et al., TALENs and ZFNs are associated with different mutationsignatures. Nat Methods. Mar. 2013;10(3):185. doi: 10.1038/nmeth.2364. Epub Feb. 10, 2013.
Kim et al., Targeted genome editing in human cells with zinc finger nucleases constructed via modular assembly. Genome Res. Jul. 2009;19(7):1279-88. doi: 10.1101/gr.089417.108. Epub May 21, 2009.
Kim et al., The role of apolipoprotein E in Alzheimer's disease. Neuron. Aug. 13, 2009;63(3):287-303. doi: 10.1016/j.neuron.2009.06.026.
Kim et al., Transcriptional repression by zinc finger peptides. Exploring the potential for applications in gene therapy. J Biol Chem. Nov. 21, 1997;272(47):29795-800.
Kitamura et al., Uracil DNA glycosylase counteracts APOBEC3G-induced hypermutation of hepatitis B viral genomes: excision repair of covalently closed circular DNA. PLoS Pathog. 2013;9(5):e1003361. doi: 10.1371/journal.ppat.1003361. Epub May 16, 2013.
Klapacz et al., Frameshift mutagenesis and microsatellite instability induced by human alkyladenine DNA glycosylase. Mol Cell. Mar. 26, 2010;37(6):843-53. doi: 10.1016/j.molcel.2010.01.038.
Klauser et al., An engineered small RNA-mediated genetic switch based on a ribozyme expression platform. Nucleic Acids Res. May 1, 2013;41(10):5542-52. doi: 10.1093/nar/gkt253. Epub Apr. 12, 2013.
Klein et al., Cocrystal structure of a class I preQ1 riboswitch reveals a pseudoknot recognizing an essential hypermodified nucleobase. Nat Struct Mol Biol. Mar. 2009;16(3):343-4. doi: 10.1038/nsmb.1563.Epub Feb. 22, 2009.
Kleinstiver et al., Broadening the targeting range of *Staphylococcus aureus* CRISPR-Cas9 by modifying PAM recognition. Nat Biotechnol. Dec. 2015;33(12):1293-1298. doi: 10.1038/nbt.3404. Epub Nov. 2, 2015.
Kleinstiver et al., Engineered CRISPR-Cas9 nucleases with altered PAM specificities. Nature. Jul. 23, 2015;523(7561):481-5. doi: 10.1038/nature14592. Epub Jun. 22, 2015.
Kleinstiver et al., High-fidelity CRISPR-Cas9 nucleases with no detectable genome-wide off-target effects. Nature. Jan. 28, 2016;529(7587):490-5. doi: 10.1038/nature16526. Epub Jan. 6, 2016.
Kleinstiver et al., Monomeric site-specific nucleases for genome editing. Proc Natl Acad Sci U S A. May 22, 2012;109(21):8061-6. doi: 10.1073/pnas.1117984109. Epub May 7, 2012.
Klement et al., Discrimination between bacteriophage T3 and T7 promoters by the T3 and T7 RNA polymerases depends primarily upon a three base-pair region located 10 to 12 base-pairs upstream from the start site. J Mol Biol. Sep. 5, 1990;215(1):21-9.
Klippel et al., Isolation and characterization of unusual gin mutants. EMBO J. Dec. 1, 1988;7(12):3983-9.
Klippel et al., The DNA invertase Gin of phage Mu: formation of a covalent complex with DNA via a phosphoserine at amino acid position 9. EMBO J. Apr. 1988;7(4):1229-37.
Knott et al., Guide-bound structures of an RNA-targeting A-cleaving CRISPR-Cas13a enzyme. Nat Struct Mol Biol. Oct. 2017;24(10):825-833. doi: 10.1038/nsmb.3466. Epub Sep. 11, 2017.
Koblan et al., Improving cytidine and adenine base editors by expression optimization and ancestral reconstruction. Nat Biotechnol. Oct. 2018;36(9):843-846. doi: 10.1038/nbt.4172. Epub May 29, 2018.
Kobori et al., Deep Sequencing Analysis of Aptazyme Variants Based on a Pistol Ribozyme. ACS Synth Biol. Jul. 21, 2017;6(7):1283-1288. doi: 10.1021/acssynbio.7b00057. Epub Apr. 14, 2017.
Kohli et al., A portable hot spot recognition loop transfers sequence preferences from APOBEC family members to activation-induced cytidine deaminase. J Biol Chem. Aug. 21, 2009;284(34):22898-904. doi: 10.1074/jbc.M109.025536. Epub Jun. 26, 2009.
Kohli et al., Local sequence targeting in the AID/APOBEC family differentially impacts retroviral restriction and antibody diversification. J Biol Chem. Dec. 24, 2010;285(52):40956-64. doi: 10.1074/jbc.M110.177402. Epub Oct. 6, 2010.

Köhrer et al., A possible approach to site-specific insertion of two different unnatural amino acids into proteins in mammalian cells via nonsense suppression. Chem Biol. Nov. 2003;10(11):1095-102.
Köhrer et al., Complete set of orthogonal 21st aminoacyl-tRNA synthetase-amber, ochre and opal suppressor tRNA pairs: concomitant suppression of three different termination codons in an mRNA in mammalian cells. Nucleic Acids Res. Dec. 1, 2004;32(21):6200-11. Print 2004.
Koike-Yusa et al., Genome-wide recessive genetic screening in mammalian cells with a lentiviral CRISPR-guide RNA library. Nat Biotechnol. Mar. 2014;32(3):267-73. doi: 10.1038/nbt.2800. Epub Dec. 23, 2013.
Komor et al., CRISPR-Based Technologies for the Manipulation of Eukaryotic Genomes. Cell. Jan. 12, 2017;168(1-2):20-36. doi: 10.1016/j.cell.2016.10.044.
Komor et al., Improved base excision repair inhibition and bacteriophage Mu Gam protein yields C:G-to-T:A base editors with higher efficiency and product purity. Sci Adv. Aug. 30, 2017;3(8):eaao4774. doi: 10.1126/sciadv.aao4774. eCollection Aug. 2017.
Komor et al., Programmable editing of a target base in genomic DNA without double-stranded DNA cleavage. Nature. Apr. 20, 2016;533(7603):420-4. doi: 10.1038/nature17946.
Komor, Editing the Genome Without Double-Stranded DNA Breaks. ACS Chem Biol. Feb. 16, 2018;13(2):383-388. doi: 10.1021/acschembio.7b00710. Epub Oct. 9, 2017.
Koonin et al., Diversity, classification and evolution of CRISPR-Cas systems. Curr Opin Microbiol. 2017;37:67?78. doi:10.1016/j.mib.2017.05.008.
Kosicki et al., Repair of double-strand breaks induced by CRISPR-Cas9 leads to large deletions and complex rearrangements. Nat Biotechnol. Sep. 2018;36(8):765-771. doi: 10.1038/nbt.4192. Epub Jul. 16, 2018.
Kotewicz et al., Isolation of cloned Moloney murine leukemia virus reverse transcriptase lacking ribonuclease H activity. Nucleic Acids Res. Jan. 11, 1988;16(1):265-77. doi: 10.1093/nar/16.1.265.
Kouzminova et al., Patterns of chromosomal fragmentation due to uracil-DNA incorporation reveal a novel mechanism of replication-dependent double-stranded breaks. Mol Microbiol. Apr. 2008;68(1):202-15. doi: 10.1111/j.1365-2958.2008.06149.x.
Kowal et al., Exploiting unassigned codons in Micrococcus luteus for tRNA-based amino acid mutagenesis. Nucleic Acids Res. Nov. 15, 1997;25(22):4685-9.
Kowalski et al., Delivering the Messenger: Advances in Technologies for Therapeutic mRNA Delivery. Mol Ther. Apr. 10, 2019;27(4):710-728. doi: 10.1016/j.ymthe.2019.02.012. Epub Feb. 19, 2019.
Kozak, An analysis of 5'-noncoding sequences from 699 vertebrate messenger RNAs. Nucleic Acids Res. Oct. 26, 1987;15(20):8125-48. doi: 10.1093/nar/15.20.8125.
Kraft et al., Deletions, Inversions, Duplications: Engineering of Structural Variants using CRISPR/Cas in Mice. Cell Rep. Feb. 10, 2015;10(5):833-839. doi: 10.1016/j.celrep.2015.01.016. Epub Feb. 7, 2015.
Krokan et al., Uracil in DNA—occurrence, consequences and repair. Oncogene. Dec. 16, 2002;21(58):8935-48. doi: 10.1038/sj.onc.1205996. PMID: 12483510.
Krokan et al., Base excision repair. Cold Spring Harb Perspect Biol. Apr. 1, 2013;5(4):a012583. doi: 10.1101/cshperspect.a012583.
Krzywkowski et al., Limited reverse transcriptase activity of phi29 DNA polymerase. Nucleic Acids Res. Apr. 20, 2018;46(7):3625-3632. doi: 10.1093/nar/gky190.
Kumar et al., Structural and functional consequences of the mutation of a conserved arginine residue in alphaA and alphaB crystallins. J Biol Chem. Aug. 20, 1999;274(34):24137-41.
Kundu et al., Leucine to proline substitution by SNP at position 197 in Caspase-9 gene expression leads to neuroblastoma: a bioinformatics analysis. 3 Biotech. 2013; 3:225-34.
Kunz et al., DNA Repair in mammalian cells: Mismatched repair: variations on a theme. Cell Mol Life Sci. Mar. 2009;66(6):1021-38. doi: 10.1007/s00018-009-8739-9.
Kury et al., De Novo Disruption of the Proteasome Regulatory Subunit PSMD12 Causes a Syndromic Neurodevelopmental Dis-

(56) References Cited

OTHER PUBLICATIONS order. Am J Hum Genet. Feb. 2, 2017;100(2):352-363. doi: 10.1016/j.ajhg.2017.01.003. Epub Jan. 26, 2017.
Kuscu et al., CRISPR-Cas9-AID base editor is a powerful gain-of-function screening tool. Nat Methods. Nov. 29, 2016;13(12):983-984. doi: 10.1038/nmeth.4076.
Kuscu et al., CRISPR-STOP: gene silencing through base-editing-induced nonsense mutations. Nat Methods. Jul. 2017;14(7):710-712. doi: 10.1038/nmeth.4327. Epub Jun. 5, 2017.
Kuscu et al., Genome-wide analysis reveals characteristics of off-target sites bound by the Cas9 endonuclease. Nat Biotechnol. Jul. 2014;32(7):677-83. doi: 10.1038/nbt.2916. Epub May 18, 2014.
Kwart et al., Precise and efficient scarless genome editing in stem cells using CORRECT. Nat Protoc. Feb. 2017;12(2):329-354. doi: 10.1038/nprot.2016.171. Epub Jan. 19, 2017.
Kwon et al., Chemical basis of glycine riboswitch cooperativity. RNA. Jan. 2008;14(1):25-34. Epub Nov. 27, 2007.
Lada et al., Mutator effects and mutation signatures of editing deaminases produced in bacteria and yeast. Biochemistry (Mosc). Jan. 2011;76(1):131-46.
Landrum et al., ClinVar: public archive of interpretations of clinically relevant variants. Nucleic Acids Res. Jan. 4, 2016;44(D1):D862-8. doi: 10.1093/nar/gkv1222. Epub Nov. 17, 2015.
Langer et al., Chemical and Physical Structure of Polymers as Carriers for Controlled Release of Bioactive Agents: A Review. Journal of Macromolecular Science, 2006;23(1):61-126. DOI: 10.1080/07366578308079439.
Langer et al., New methods of drug delivery. Science. Sep. 28, 1990;249(4976):1527-33.
Larson et al., CRISPR interference (CRISPRi) for sequence-specific control of gene expression. Nat Protoc. Nov. 2013;8(11):2180-96. doi: 10.1038/nprot.2013.132. Epub Oct. 17, 2013.
Lau et al., Molecular basis for discriminating between normal and damaged bases by the human alkyladenine glycosylase, AAG. Proc Natl Acad Sci U S A. Dec. 5, 2000;97(25):13573-8.
Lauer et al., Construction, characterization, and use of two Listeria monocytogenes site-specific phage integration vectors. J Bacteriol. Aug. 2002;184(15):4177-86. doi: 10.1128/jb.184.15.4177-4186.2002.
Lavergne et al., Defects in type IIA von Willebrand disease: a cysteine 509 to arginine substitution in the mature von Willebrand factor disrupts a disulphide loop involved in the interaction with platelet glycoprotein Ib-IX. Br J Haematol. Sep. 1992;82(1):66-72.
Lawrence et al., Supercharging proteins can impart unusual resilience. J Am Chem Soc. Aug. 22, 2007;129(33):10110-2. Epub Aug. 1, 2007.
Lawyer et al., High-level expression, purification, and enzymatic characterization of full-length Thermus aquaticus DNA polymerase and a truncated form deficient in 5' to 3' exonuclease activity. PCR Methods Appl. May 1993;2(4):275-87. doi: 10.1101/gr.2.4.275.
Lazar et al., Transforming growth factor alpha: mutation of aspartic acid 47 and leucine 48 results in different biological activities. Mol Cell Biol. Mar. 1988;8(3):1247-52.
Lazarevic et al., Nucleotide sequence of the Bacillus subtilis temperate bacteriophage SPbetac2. Microbiology (Reading). May 1999;145 ( Pt 5):1055-1067. doi: 10.1099/13500872-145-5-1055.
Le Grice et al., Purification and characterization of recombinant equine infectious anemia virus reverse transcriptase. J Virol. Dec. 1991;65(12):7004-7. doi: 10.1128/JVI.65.12.7004-7007.1991.
Leaver-Fay et al., ROSETTA3: an object-oriented software suite for the simulation and design of macromolecules. Methods Enzymol. 2011;487:545-74. doi: 10.1016/B978-0-12-381270-4.00019-6.
Leconte et al., A population-based experimental model for protein evolution: effects of mutation rate and selection stringency on evolutionary outcomes. Biochemistry. Feb. 26, 2013;52(8):1490-9. doi: 10.1021/bi3016185. Epub Feb. 14, 2013.
Ledford, Gene-editing hack yields pinpoint precision. Nature, Apr. 20, 2016. http://www.nature.com/news/gene-editing-hack-yields-pinpoint-precision-1.19773.
Lee et al., A chimeric thyroid hormone receptor constitutively bound to DNA requires retinoid X receptor for hormone-dependent transcriptional activation in yeast. Mol Endocrinol. Sep. 1994;8(9):1245-52.
Lee et al., An allosteric self-splicing ribozyme triggered by a bacterial second messenger. Science. Aug. 13, 2010;329(5993):845-8. doi: 10.1126/science.1190713.
Lee et al., Failure to detect DNA-guided genome editing using Natronobacterium gregoryi Argonaute. Nat Biotechnol. Nov. 28, 2016;35(1):17-18. doi: 10.1038/nbt.3753.
Lee et al., PIK3CA gene is frequently mutated in breast carcinomas and hepatocellular carcinomas. Oncogene. Feb. 17, 2005;24(8):1477-80.
Lee et al., Recognition of liposomes by cells: in vitro binding and endocytosis mediated by specific lipid headgroups and surface charge density. Biochim Biophys Acta. Jan. 31, 1992;1103(2):185-97.
Lee et al., Ribozyme Mediated gRNA Generation for In Vitro and In Vivo CRISPR/Cas9 Mutagenesis. PLoS One. Nov. 10, 2016;11(11):e0166020. doi: 10.1371/journal.pone.0166020. eCollection 2016.
Lee et al., Site-specific integration of mycobacteriophage L5: integration-proficient vectors for *Mycobacterium smegmatis*, *Mycobacterium tuberculosis*, and bacille Calmette-Guérin. Proc Natl Acad Sci U S A. Apr. 15, 1991;88(8):3111-5. doi: 10.1073/pnas.88.8.3111.
Lee et al., Synthetically modified guide RNA and donor DNA are a versatile platform for CRISPR-Cas9 engineering. Elife. May 2, 2017;6:e25312. doi: 10.7554/eLife.25312.
Lee et al., Transcriptional regulation and its misregulation in disease. Cell. Mar. 14, 2013;152(6):1237-51. doi: 10.1016/j.cell.2013.02.014.
Lei et al., Efficient targeted gene disruption in Xenopus embryos using engineered transcription activator-like effector nucleases (TALENs). Proc Natl Acad Sci U S A. Oct. 23, 2012;109(43):17484-9. Doi: 10.1073/pnas.1215421109. Epub Oct. 8, 2012.
Lei et al., Site-specificity of serine integrase demonstrated by the attB sequence preference of BT1 integrase. FEBS Lett. Apr. 2018;592(8):1389-1399. doi: 10.1002/1873-3468.13023. Epub Mar. 25, 2018.
Lemos et al., CRISPR/Cas9 cleavages in budding yeast reveal templated insertions and strand-specific insertion/deletion profiles. Proc Natl Acad Sci U S A. Feb. 27, 2018;115(9):E2040-E2047. doi: 10.1073/pnas.1716855115. Epub Feb. 13, 2018.
Lenk et al., Pathogenic mechanism of the FIG4 mutation responsible for Charcot-Marie-Tooth disease CMT4J. PLoS Genet. Jun. 2011;7(6):e1002104. doi: 10.1371/journal.pgen.1002104. Epub Jun. 2, 2011.
Levy et al., Inhibition of calcification of bioprosthetic heart valves by local controlled-release diphosphonate. Science. Apr. 12, 1985;228(4696):190-2.
Levy et al., Membrane-associated guanylate kinase dynamics reveal regional and developmental specificity of synapse stability. J Physiol. Mar. 1, 2017;595(5):1699-1709. doi: 10.1113/JP273147. Epub Jan. 18, 2017.
Levy et al., Cytosine and adenine base editing of the brain, liver, retina, heart and skeletal muscle of mice via adeno-associated viruses. Nat Biomed Eng. 2020;4(1):97-110. doi:10.1038/s41551-019-0501-5.
Lew et al., Protein splicing in vitro with a semisynthetic two-component minimal intein. J Biol Chem. Jun. 26, 1998;273(26):15887-90. doi: 10.1074/jbc.273.26.15887.
Lewis et al., A serum-resistant cytofectin for cellular delivery of antisense oligodeoxynucleotides and plasmid DNA. Proc Natl Acad Sci U S A. Apr. 16, 1996;93(8):3176-81.
Lewis et al., Building the Class 2 CRISPR-Cas Arsenal. Mol Cell 2017;65(3);377-379.
Lewis et al., Codon 129 polymorphism of the human prion protein influences the kinetics of amyloid formation. J Gen Virol. Aug. 2006;87(Pt 8):2443-9.
Lewis et al., Cytosine deamination and the precipitous decline of spontaneous mutation during Earth's history. Proc Natl Acad Sci U S A. Jul. 19, 2016;113(29):8194-9. doi: 10.1073/pnas.1607580113. Epub Jul. 5, 2016.

(56) References Cited

OTHER PUBLICATIONS

Li et al., A Radioactivity-Based Assay for Screening Human m6A-RNA Methyltransferase, METTL3-METTL14 Complex, and Demethylase ALKBH5. J Biomol Screen. Mar. 2016;21(3):290-7. doi: 10.1177/1087057115623264. Epub Dec. 23, 2015.
Li et al., Base editing with a Cpf1-cytidine deaminase fusion. Nat Biotechnol. Apr. 2018;36(4):324-327. doi: 10.1038/nbt.4102. Epub Mar. 19, 2018.
Li et al., Current approaches for engineering proteins with diverse biological properties. Adv Exp Med Biol. 2007;620:18-33.
Li et al., Fast and accurate short read alignment with Burrows-Wheeler transform. Bioinformatics. Jul. 15, 2009;25(14):1754-60. doi: 10.1093/bioinformatics/btp324. Epub May 18, 2009.
Li et al., Generation of Targeted Point Mutations in Rice by a Modified CRISPR/Cas9 System. Mol Plant. Mar. 6, 2017;10(3):526-529. doi: 10.1016/j.molp.2016.12.001. Epub Dec. 8, 2016.
Li et al., Highly efficient and precise base editing in discarded human tripronuclear embryos. Protein Cell. Aug. 19, 2017. doi: 10.1007/s13238-017-0458-7. [Epub ahead of print].
Li et al., Lagging strand DNA synthesis at the eukaryotic replication fork involves binding and stimulation of FEN-1 by proliferating cell nuclear antigen. J Biol Chem. Sep. 22, 1995;270(38):22109-12. doi: 10.1074/jbc.270.38.22109.
Li et al., Modularly assembled designer TAL effector nucleases for targeted gene knockout and gene replacement in eukaryotes. Nucleic Acids Res. Aug. 2011;39(14):6315-25. doi: 10.1093/nar/gkr188. Epub Mar. 31, 2011.
Li et al., Multiplex and homologous recombination-mediated genome editing in *Arabidopsis* and Nicotiana benthamiana using guide RNA and Cas9. Nat Biotechnol. Aug. 2013;31(8):688-91. doi: 10.1038/nbt.2654.
Li et al., Protein trans-splicing as a means for viral vector-mediated in vivo gene therapy. Hum Gene Ther. Sep. 2008;19(9):958-64. doi: 10.1089/hum.2008.009.
Li et al., TAL nucleases (TALNs): hybrid proteins composed of TAL effectors and FokI DNA-cleavage domain. Nucleic Acids Res. Jan. 2011;39(1):359-72. doi: 10.1093/nar/gkq704. Epub Aug. 10, 2010.
Liang et al., Correction of β-thalassemia mutant by base editor in human embryos. Protein Cell. Nov. 2017;8(11):811-822. doi: 10.1007/s13238-017-0475-6. Epub Sep. 23, 2017.
Liang et al., Rapid and highly efficient mammalian cell engineering via Cas9 protein transfection. Send to; J Biotechnol. Aug. 20, 2015;208:44-53. doi: 10.1016/j.jbiotec.2015.04.024.
Lieber et al., Mechanism and regulation of human non-homologous DNA end-joining. Nat Rev Mol Cell Biol. Sep. 2003;4(9):712-20.
Lienert et al., Two- and three-input TALE-based AND logic computation in embryonic stem cells. Nucleic Acids Res. Nov. 2013;41(21):9967-75. doi: 10.1093/nar/gkt758. Epub Aug. 27, 2013.
Lilley, D.M. The Varkud Satellite Ribozyme. RNA. Feb. 2004;10(2):151-8. doi: 10.1261/rna.5217104.
Lim et al., Crystal structure of the moloney murine leukemia virus RNase H domain. J Virol. Sep. 2006;80(17):8379-89. doi: 10.1128/JVI.00750-06.
Lin et al., Enhanced homology-directed human genome engineering by controlled timing of CRISPR/Cas9 delivery. Elife. Dec. 15, 2014;3:e04766. doi: 10.7554/eLife.04766.
Link et al., Engineering ligand-responsive gene-control elements: lessons learned from natural riboswitches. Gene Ther. Oct. 2009;16(10):1189-201. doi: 10.1038/gt.2009.81. Epub Jul. 9, 2009. Review.
Liu et al., C2c1-sgRNA Complex Structure Reveals RNA-Guided DNA Cleavage Mechanism. Molecular Cell Jan. 2017;65(2):310-22.
Liu et al., Split dnaE genes encoding multiple novel inteins in Trichodesmium erythraeum. J Biol Chem. Jul. 18, 2003;278(29):26315-8. doi: 10.1074/jbc.C300202200. Epub May 24, 2003.
Liu et al., A METTL3-METTL14 complex mediates mammalian nuclear RNA N6-adenosine methylation. Nat Chem Biol. Feb. 2014;10(2):93-5. doi: 10.1038/nchembio.1432. Epub Dec. 6, 2013.

Liu et al., Apolipoprotein E and Alzheimer disease: risk, mechanisms and therapy. Nat Rev Neurol. Feb. 2013;9(2):106-18. doi: 10.1038/nrneurol.2012.263. Epub Jan. 8, 2013.
Liu et al., Balancing AID and DNA repair during somatic hypermutation. Trends Immunol. Apr. 2009;30(4):173-81. doi: 10.1016/j.it.2009.01.007.
Liu et al., CasX enzymes comprise a distinct family of RNA-guided genome editors. Nature. Feb. 2019;566(7743):218-223. doi: 10.1038/s41586-019-0908-x. Epub Feb. 4, 2019.
Liu et al., Cell-penetrating peptide-mediated delivery of TALEN proteins via bioconjugation for genome engineering. PLoS One. Jan. 20, 2014;9(1):e85755. doi: 10.1371/journal.pone.0085755. eCollection 2014.
Liu et al., Design of polydactyl zinc-finger proteins for unique addressing within complex genomes. Proc Natl Acad Sci U S A. May 27, 1997;94(11):5525-30.
Liu et al., Direct Promoter Repression by BCL11A Controls the Fetal to Adult Hemoglobin Switch. Cell. Apr. 5, 2018;173(2):430-442.e17. doi: 10.1016/j.cell.2018.03.016. Epub Mar. 29, 2018.
Liu et al., Distance determination by GIY-YIG intron endonucleases: discrimination between repression and cleavage functions. Nucleic Acids Res. Mar. 31, 2006;34(6):1755-64. Print 2006.
Liu et al., Editing DNA Methylation in the Mammalian Genome. Cell. Sep. 22, 2016;167(1):233-247.e17. doi: 10.1016/j.cell.2016.08.056.
Liu et al., Engineering a tRNA and aminoacyl-tRNA synthetase for the site-specific incorporation of unnatural amino acids into proteins in vivo. Proc Natl Acad Sci U S A. Sep. 16, 1997;94(19):10092-7.
Liu et al., Fast Colorimetric Sensing of Adenosine and Cocaine Based on a General Sensor Design Involving Aptamers and Nanoparticles. Angew Chem. Dec. 16, 2006;45(1):90-4. DOI: 10.1002/anie.200502589.
Liu et al., Fast Colorimetric Sensing of Adenosine and Cocaine Based on a General Sensor Design Involving Aptamers and Nanoparticles. Angew Chem. 2006;118(1):96-100.
Liu et al., Functional Nucleic Acid Sensors. Chem Rev. May 2009;109(5):1948-98. doi: 10.1021/cr030183i.
Liu et al., Highly efficient RNA-guided base editing in rabbit. Nat Commun. Jul. 13, 2018;9(1):2717. doi: 10.1038/s41467-018-05232-2.
Liu et al., N(6)-methyladenosine-dependent RNA structural switches regulate RNA-protein interactions. Nature. Feb. 26, 2015;518(7540):560-4. doi: 10.1038/nature14234.
Liu et al., Probing N6-methyladenosine RNA modification status at single nucleotide resolution in mRNA and long noncoding RNA. RNA. Dec. 2013;19(12):1848-56. doi: 10.1261/rna.041178.113. Epub Oct. 18, 2013.
Liu et al., The Molecular Architecture for RNA-Guided RNA Cleavage by Cas13a. Cell. Aug. 10, 2017;170(4):714-726.e10. doi: 10.1016/j.cell.2017.06.050. Epub Jul. 27, 2017.
Loessner et al., Complete nucleotide sequence, molecular analysis and genome structure of bacteriophage A118 of Listeria monocytogenes: implications for phage evolution. Mol Microbiol. Jan. 2000;35(2):324-40. doi: 10.1046/j.1365-2958.2000.01720.x.
Lombardo et al., Gene editing in human stem cells using zinc finger nucleases and integrase-defective lentiviral vector delivery. Nat Biotechnol. Nov. 2007;25(11):1298-306. Epub Oct. 28, 2007.
Long et al., Postnatal genome editing partially restores dystrophin expression in a mouse model of muscular dystrophy. Science. Jan. 22, 2016;351(6271):400-3. doi: 10.1126/science.aad5725. Epub Dec. 31, 2015.
Losey et al., Crystal structure of *Staphylococcus sureus* tRNA adenosine deaminase tadA in complex with RNA. Nature Struct. Mol. Biol. Feb. 2006;13(2):153-9.
Lu et al., Precise Editing of a Target Base in the Rice Genome Using a Modified CRISPR/Cas9 System. Mol Plant. Mar. 6, 2017;10(3):523-525. doi: 10.1016/j.molp.2016.11.013. Epub Dec. 6, 2016.
Lundberg et al., Delivery of short interfering RNA using endosomolytic cell-penetrating peptides. FASEB J. Sep. 2007;21(11):2664-71. Epub Apr. 26, 2007.
Lundquist et al., Site-directed mutagenesis and characterization of uracil-DNA glycosylase inhibitor protein. Role of specific carbox-

(56) References Cited

OTHER PUBLICATIONS ylic amino acids in complex formation with *Escherichia coli* uracil-DNA glycosylase. J Biol Chem. Aug. 22, 1997;272(34):21408-19.

Lynch, Evolution of the mutation rate. Trends Genet. Aug. 2010;26(8):345-52. doi: 10.1016/j.tig.2010.05.003. Epub Jun. 30, 2010.

Lyons et al., Efficient Recognition of an Unpaired Lesion by a DNA Repair Glycosylase. J. Am. Chem. Soc., 2009;131(49):17742-3. DOI: 10.1021/ja908378y.

Ma et al., Single-Stranded DNA Cleavage by Divergent CRISPR-Cas9 Enzymes. Mol Cell. Nov. 5, 2015;60(3):398-407. doi: 10.1016/j.molcel.2015.10.030.

Ma et al., Targeted AID-mediated mutagenesis (TAM) enables efficient genomic diversification in mammalian cells. Nature Methods. Oct. 2016;13:1029-35. doi: 10.1038/nmeth.4027.

Maas et al., Identification and characterization of a human tRNA-specific adenosine deaminase related to the ADAR family of pre-mRNA editing enzymes. Proc Natl Acad Sci U S A. Aug. 3, 1999;96(16):8895-900. doi: 10.1073/pnas.96.16.8895.

Macbeth et al., Inositol hexakisphosphate is bound in the ADAR2 core and required for RNA editing. Science. Sep. 2, 2005;309(5740):1534-9. doi: 10.1126/science.1113150.

Maeder et al., CRISPR RNA-guided activation of endogenous human genes. Nat Methods. Oct. 2013;10(10):977-9. doi: 10.1038/nmeth.2598. Epub Jul. 25, 2013.

Maeder et al., Rapid "open-source" engineering of customized zinc-finger nucleases for highly efficient gene modification. Mol Cell. Jul. 25, 2008;31(2):294-301. doi:10.1016/j.molcel.2008.06.016.

Maeder et al., Robust, synergistic regulation of human gene expression using TALE activators. Nat Methods. Mar. 2013;10(3):243-5. doi: 10.1038/nmeth.2366. Epub Feb. 10, 2013.

Magin et al., Corf, the Rev/Rex homologue of HTDV/HERV-K, encodes an arginine-rich nuclear localization signal that exerts a trans-dominant phenotype when mutated. Virology. Aug. 15, 2000;274(1):11-6. doi: 10.1006/viro.2000.0438.

Mahfouz et al., De novo-engineered transcription activator-like effector (TALE) hybrid nuclease with novel DNA binding specificity creates double-strand breaks. Proc Natl Acad Sci U S A. Feb. 8, 2011;108(6):2623-8. doi: 10.1073/pnas.1019533108. Epub Jan. 24, 2011.

Makarova et al., Prokaryotic homologs of Argonaute proteins are predicted to function as key components of a novel system of defense against mobile genetic elements. Biology Direct 2009;4:29.

Makarova et al., An updated evolutionary classification of CRISPR-Cas systems. Nat Rev Microbiol. Nov. 2015;13(11):722-36. doi: 10.1038/nrmicro3569. Epub Sep. 28, 2015.

Makarova et al., Classification and Nomenclature of CRISPR-Cas Systems: Where from Here? CRISPR J. Oct. 2018;1(5):325-336. doi: 10.1089/crispr.2018.0033.

Makarova et al., Evolution and classification of the CRISPR-Cas systems. Nat Rev Microbiol. Jun. 2011;9(6):467-77. doi: 10.1038/nrmicro2577. Epub May 9, 2011.

Makeyev et al., Evolutionary potential of an RNA virus. J Virol. Feb. 2004;78(4):2114-20.

Malashkevich et al., Crystal structure of tRNA adenosine deaminase TadA from *Escherichia coli*. Deposited: Mar. 10, 2005 Released: Feb. 21, 2006 doi:10.2210/pdb1z3a/pdb (2006).

Mali et al., Cas9 as a versatile tool for engineeringbiology. Nat Methods. Oct. 2013;10(10):957-63. doi: 10.1038/nmeth.2649.

Mali et al., CAS9 transcriptional activators for target specificity screening and paired nickases for cooperative genome engineering. Nat Biotechnol. Sep. 2013;31(9):833-8. doi: 10.1038/nbt.2675. Epub Aug. 1, 2013.

Mali et al., RNA-guided human genome engineering via Cas9. Science. Feb. 15, 2013;339(6121):823-6. doi: 10.1126/science.1232033. Epub Jan. 3, 2013.

Malito et al., Structural basis for lack of toxicity of the diphtheria toxin mutant CRM197. Proc Natl Acad Sci U S A. Apr. 3, 2012;109(14):5229-34. doi: 10.1073/pnas.1201964109. Epub Mar. 19, 2012.

Mandal et al., Efficient ablation of genes in human hematopoietic stem and effector cells using CRISPR/Cas9. Cell Stem Cell. Nov. 6, 2014;15(5):643-52. doi: 10.1016/j.stem.2014.10.004. Epub Nov. 6, 2014.

Mandal et al., Riboswitches Control Fundamental Biochemical Pathways in Bacillus Subtilis and Other Bacteria. Cell. May 30, 2003;113(5):577-86. doi: 10.1016/s0092-8674(03)00391-x.

Mani et al., Design, engineering, and characterization of zinc finger nucleases. Biochem Biophys Res Commun. Sep. 23, 2005;335(2):447-57.

Marioni et al., DNA methylation age of blood predicts all-cause mortality in later life. Genome Biol. Jan. 30, 2015;16:25. doi: 10.1186/s13059-015-0584-6.

Marraffini et al., CRISPR interference limits horizontal gene transfer in staphylococci by targeting DNA. Science. Dec. 19, 2008;322(5909):1843-5. doi: 10.1126/science.1165771.

Martinez et al., Hypermutagenesis of RNA using human immunodeficiency virus type 1 reverse transcriptase and biased dNTP concentrations. Proc Natl Acad Sci U S A. Dec. 6, 1994;91(25):11787-91. doi: 10.1073/pnas.91.25.11787.

Maruyama et al., Increasing the efficiency of precise genome editing with CRISPR-Cas9 by inhibition of nonhomologous end joining. Nat Biotechnol. May 2015;33(5):538-42. doi: 10.1038/nbt.3190. Epub Mar. 23, 2015.

Mascola et al., HIV-1 neutralizing antibodies: understanding nature's pathways. Immunol Rev. Jul. 2013;254(1):225-44. doi: 10.1111/imr.12075.

Matsuura et al., A gene essential for the site-specific excision of actinophage r4 prophage genome from the chromosome of a lysogen. J Gen Appl Microbiol. 1995;41(1):53-61.

Matthews, Structures of human ADAR2 bound to dsRNA reveal base-flipping mechanism and basis for site selectivity. Nat Struct Mol Biol. May 2016;23(5):426-33. doi: 10.1038/nsmb.3203. Epub Apr. 11, 2016.

May et al., Emergent lineages of mumps virus suggest the need for a polyvalent vaccine. Int J Infect Dis. Jan. 2018;66:1-4. doi: 10.1016/j.ijid.2017.09.024. Epub Oct. 4, 2017.

Mcinerney et al., Error Rate Comparison during Polymerase Chain Reaction by DNA Polymerase. Mol Biol Int. 2014;2014:287430. doi: 10.1155/2014/287430. Epub Aug. 17, 2014.

Mckenna et al., Recording development with single cell dynamic lineage tracing. Development. Jun. 27, 2019;146(12):dev169730. doi: 10.1242/dev.169730.

Mckenna et al., Whole-organism lineage tracing by combinatorial and cumulative genome editing. Science. Jul. 29, 2016;353(6298):aaf7907. doi: 10.1126/science.aaf7907. Epub May 26, 2016.

Mcnaughton et al., Mammalian cell penetration, siRNA transfection, and DNA transfection by supercharged proteins. Proc Natl Acad Sci U S A. Apr. 14, 2009;106(15):6111-6. doi: 10.1073/pnas.0807883106. Epub Mar. 23, 2009.

Mcvey et al., MMEJ repair of double-strand breaks (director's cut): deleted sequences and alternative endings. Trends Genet. Nov. 2008;24(11):529-38. doi: 10.1016/j.tig.2008.08.007. Epub Sep. 21, 2008.

Mead et al., A novel protective prion protein variant that colocalizes with kuru exposure. N Engl J Med. Nov. 19, 2009;361(21):2056-65. doi: 10.1056/NEJMoa0809716.

Mei et al., Recent Progress in CRISPR/Cas9 Technology. J Genet Genomics. Feb. 20, 2016;43(2):63-75. doi: 10.1016/j.jgg.2016.01.001. Epub Jan. 18, 2016.

Menéndez-Arias, Mutation rates and intrinsic fidelity of retroviral reverse transcriptases. Viruses. Dec. 2009;1(3):1137-65. doi: 10.3390/v1031137. Epub Dec. 4, 2009.

Meng et al., Targeted gene inactivation in zebrafish using engineered zinc-finger nucleases. Nat Biotechnol. Jun. 2008;26(6):695-701. doi: 10.1038/nbt1398. Epub May 25, 2008.

(56) References Cited

OTHER PUBLICATIONS

Mercer et al., Chimeric TALE recombinases with programmable DNA sequence specificity. Nucleic Acids Res. Nov. 2012;40(21):11163-72. doi: 10.1093/nar/gks875. Epub Sep. 26, 2012.
Mertens et al., Site-specific recombination in bacteriophage Mu: characterization of binding sites for the DNA invertase Gin. EMBO J. Apr. 1988;7(4):1219-27.
Meyer et al., Breathing life into polycations: functionalization with pH-responsive endosomolytic peptides and polyethylene glycol enables siRNA delivery. J Am Chem Soc. Mar. 19, 2008;130(11):3272-3. doi: 10.1021/ja710344v. Epub Feb. 21, 2008.
Meyer et al., Comprehensive analysis of mRNA methylation reveals enrichment in 3' UTRs and near stop codons. Cell. Jun. 22, 2012;149(7):1635-46. doi: 10.1016/j.cell.2012.05.003. Epub May 17, 2012.
Meyer et al., Confirmation of a second natural preQ1 aptamer class in Streptococcaceae bacteria. RNA. Apr. 2008;14(4):685-95. doi: 10.1261/rna.937308. Epub Feb. 27, 2008.
Meyer et al., Library generation by gene shuffling. Curr Protoc Mol Biol. Jan. 6, 2014;105:Unit 15.12.. doi: 10.1002/0471142727.mb1512s105.
Meyer et al., The dynamic epitranscriptome: N6-methyladenosine and gene expression control. Nat Rev Mol Cell Biol. May 2014;15(5):313-26. doi: 10.1038/nrm3785. Epub Apr. 9, 2014.
Midoux et al., Chemical vectors for gene delivery: a current review on polymers, peptides and lipids containing histidine or imidazole as nucleic acids carriers. Br J Pharmacol. May 2009;157(2):166-78. doi: 10.1111/j.1476-5381.2009.00288.x.
Mihai et al., PTEN inhibition improves wound healing in lung epithelia through changes in cellular mechanics that enhance migration. Am J Physiol Lung Cell Mol Physiol. 2012;302(3):L287-L299.
Miller et al., A TALE nuclease architecture for efficient genome editing. Nat Biotechnol. Feb. 2011;29(2):143-8. doi:10.1038/nbt.1755. Epub Dec. 22, 2010.
Miller et al., An improved zinc-finger nuclease architecture for highly specific genome editing. Nat Biotechnol. Jul. 2007;25(7):778-85. Epub Jul. 1, 2007.
Miller et al., Construction and properties of retrovirus packaging cells based on gibbon ape leukemia virus. J Virol. May 1991;65(5):2220-4. doi: 10.1128/JVI.65.5.2220-2224.1991.
Mills et al., Protein splicing in trans by purified N- and C-terminal fragments of the *Mycobacterium tuberculosis* RecA intein. Proc Natl Acad Sci U S A. Mar. 31, 1998;95(7):3543-8. doi: 10.1073/pnas.95.7.3543.
Minoche et al., Evaluation of genomic high-throughput sequencing data generated on Illumina HiSeq and genome analyzer systems. Genome Biol. Nov. 8, 2011;12(11):R112. doi: 10.1186/gb-2011-12-11-r112.
Minoretti et al., A W148R mutation in the human FOXD4 gene segregating with dilated cardiomyopathy, obsessive-compulsive disorder, and suicidality. Int J Mol Med. Mar. 2007;19(3):369-72.
Mir et al., Two Active Site Divalent Ions in the Crystal Structure of the Hammerhead Ribozyme Bound to a Transition State Analogue. Biochemistry . . . Feb. 2, 2016;55(4):633-6. doi: 10.1021/acs.biochem.5b01139. Epub Jan. 19, 2016.
Mishina et al., Conditional gene targeting on the pure C57BL/6 genetic background. Neurosci Res. Jun. 2007;58(2):105-12. doi: 10.1016/j.neures.2007.01.004. Epub Jan. 18, 2007.
Mitton-Fry et al., Poly(A) tail recognition by a viral RNA element through assembly of a triple helix. Science. Nov. 26, 2010;330(6008):1244-7. doi: 10.1126/science.1195858.
Moede et al., Identification of a nuclear localization signal, RRMKWKK, in the homeodomain transcription factor PDX-1. FEBS Lett. Nov. 19, 1999;461(3):229-34. doi: 10.1016/s0014-5793(99)01446-5.
Mohr et al., A Reverse Transcriptase-Cas1 Fusion Protein Contains a Cas6 Domain Required for Both CRISPR RNA Biogenesis and RNA Spacer Acquisition. Mol Cell. Nov. 15, 2018;72(4):700-714.e8. doi: 10.1016/j.molcel.2018.09.013. Epub Oct. 18, 2018.
Mohr et al., Thermostable group II intron reverse transcriptase fusion proteins and their use in cDNA synthesis and next-generation RNA sequencing. RNA. Jul. 2013;19(7):958-70. doi: 10.1261/rna.039743.113. Epub May 22, 2013.
Mojica et al., Intervening sequences of regularly spaced prokaryotic repeats derive from foreign genetic elements. J Mol Evol. Feb. 2005;60(2):174-82.
Mol et al., Crystal structure of human uracil-DNA glycosylase in complex with a protein inhibitor: protein mimicry of DNA. Cell. Sep. 8, 1995;82(5):701-8.
Monahan et al., Site-specific incorporation of unnatural amino acids into receptors expressed in Mammalian cells. Chem Biol. Jun. 2003;10(6):573-80.
Monot et al., The specificity and flexibility of l1 reverse transcription priming at imperfect T-tracts. PLoS Genet. May 2013;9(5):e1003499. doi: 10.1371/journal.pgen.1003499. Epub May 9, 2013.
Montange et al., Structure of the S-adenosylmethionine riboswitch regulatory mRNA element. Nature. Jun. 29, 2006;441(7097):1172-5.
Moore et al., Improved somatic mutagenesis in zebrafish using transcription activator-like effector nucleases (TALENs). PLoS One. 2012;7(5):e37877. Doi: 10.1371/journal.pone.0037877. Epub May 24, 2012.
Mootz et al., Conditional protein splicing: a new tool to control protein structure and function in vitro and in vivo. J Am Chem Soc. Sep. 3, 2003;125(35):10561-9.
Mootz et al., Protein splicing triggered by a small molecule. J Am Chem Soc. Aug. 7, 2002;124(31):9044-5.
Morbitzer et al., Assembly of custom TALE-type DNA binding domains by modular cloning. Nucleic Acids Res. Jul. 2011;39(13):5790-9. doi: 10.1093/nar/gkr151. Epub Mar. 18, 2011.
Morita et al., The site-specific recombination system of actinophage TG1. FEMS Microbiol Lett. Aug. 2009;297(2):234-40. doi: 10.1111/j.1574-6968.2009.01683.x.
Morris et al., A peptide carrier for the delivery of biologically active proteins into mammalian cells. Nat Biotechnol. Dec. 2001;19(12):1173-6.
Moscou et al., A simple cipher governs DNA recognition by TAL effectors. Science. Dec. 11, 2009;326(5959):1501. doi: 10.1126/science.1178817.
Muir et al., Expressed protein ligation: a general method for protein engineering. Proc Natl Acad Sci U S A. Jun. 9, 1998;95(12):6705-10. doi: 10.1073/pnas.95.12.6705.
Muller et al., Nucleotide exchange and excision technology (NExT) DNA shuffling: a robust method for DNA fragmentation and directed evolution. Nucleic Acids Res. Aug. 1, 2005;33(13):e117. doi: 10.1093/nar/gni116. PMID: 16061932; PMCID: PMC1182171.
Mullins et al., Transgenesis in nonmurine species. Hypertension. Oct. 1993;22(4):630-3.
Mussolino et al., A novel TALE nuclease scaffold enables high genome editing activity in combination with low toxicity. Nucleic Acids Res. Nov. 2011;39(21):9283-93. Doi: 10.1093/nar/gkr597. Epub Aug. 3, 2011.
Mussolino et al., TALE nucleases: tailored genome engineering made easy. Curr Opin Biotechnol. Oct. 2012;23(5):644-50. doi: 10.1016/j.copbio.2012.01.013. Epub Feb. 17, 2012.
Muzyczka et al., Adeno-associated virus (AAV) vectors: will they work? J Clin Invest. Oct. 1994;94(4):1351. doi: 10.1172/JCI117468.
Myerowitz et al., The major defect in Ashkenazi Jews with Tay-Sachs disease is an insertion in the gene for the alpha-chain of beta-hexosaminidase. J Biol Chem. Dec. 15, 1988;263(35):18587-9.
Nabel et al., Direct gene transfer for immunotherapy and immunization. Trends Biotechnol. May 1993;11(5):211-5. doi: 10.1016/0167-7799(93)90117-R.
Nahvi et al., Coenzyme B12 riboswitches are widespread genetic control elements in prokaryotes. Nucleic Acids Res. Jan. 2, 2004;32(1):143-50.
Nakade et al., Microhomology-mediated end-joining-dependent integration of donor DNA in cells and animals using TALENs and CRISPR/Cas9. Nat Commun. Nov. 20, 2014;5:5560. doi: 10.1038/ncomms6560.

(56) References Cited

OTHER PUBLICATIONS

Nakamura et al., Codon usage tabulated from international DNA sequence databases: status for the year 2000. Nucleic Acids Res. Jan. 1, 2000;28(1):292. doi: 10.1093/nar/28.1.292.

Naorem et al., DGR mutagenic transposition occurs via hypermutagenic reverse transcription primed by nicked template RNA. Proc Natl Acad Sci U S A. Nov. 21, 2017;114(47):E10187-E10195. doi: 10.1073/pnas.1715952114. Epub Nov. 6, 2017.

Narayanan et al., Clamping down on weak terminal base pairs: oligonucleotides with molecular caps as fidelity-enhancing elements at the 5'- and 3'-terminal residues. Nucleic Acids Res. May 20, 2004;32(9):2901-11. Print 2004.

Navaratnam et al., An overview of cytidine deaminases. Int J Hematol. Apr. 2006;83(3):195-200.

Neel et al., Riboswitches: Classification, function and in silico approach, International Journal of Pharma Sciences and Research. 2010;1(9):409-420.

Nelson et al., Filamentous phage DNA cloning vectors: a noninfective mutant with a nonpolar deletion in gene III. Virology. 1981; 108(2): 338-50.

Nern et al., Multiple new site-specific recombinases for use in manipulating animal genomes. Proc Natl Acad Sci U S A. Aug. 23, 2011;108(34):14198-203. doi: 10.1073/pnas.1111704108. Epub Aug. 9, 2011.

Nguyen et al., Evolutionary drivers of thermoadaptation in enzyme catalysis. Science. Jan. 20, 2017;355(6322):289-294. doi: 10.1126/science.aah3717. Epub Dec. 22, 2016.

Nguyen et al., IQ-TREE: a fast and effective stochastic algorithm for estimating maximum-likelihood phylogenies. Mol Biol Evol. Jan. 2015;32(1):268-74. doi: 10.1093/molbev/msu300. Epub Nov. 3, 2014.

Ni et al., A PCSK9-binding antibody that structurally mimics the EGF(A) domain of LDL-receptor reduces LDL cholesterol in vivo. J Lipid Res. 2011;52:76-86.

Ni et al., Nucleic acid aptamers: clinical applications and promising new horizons. Curr Med Chem. 2011;18(27):4206-14. Review.

Nishida et al., Targeted nucleotide editing using hybrid prokaryotic and vertebrate adaptive immune systems. Science. Sep. 16, 2016;353(6305):1248. pii: aaf8729. doi: 10.1126/science.aaf8729. Epub Aug. 4, 2016.

Nishikura, Functions and regulation of RNA editing by ADAR deaminases. Annu Rev Biochem. 2010;79:321-349. doi:10.1146/annurev-biochem-060208-105251.

Nishimasu et al., Crystal structure of Cas9 in complex with guide RNA and target DNA. Cell. Feb. 27, 2014;156(5):935-49. doi: 10.1016/j.cell.2014.02.001. Epub Feb. 13, 2014.

Nishimasu et al., Crystal Structure of *Staphylococcus aureus* Cas9. Cell. Aug. 27, 2015;162(5):1113-26. doi: 10.1016/j.cell.2015.08.007.

Nishimasu et al., Engineered CRISPR-Cas9 nuclease with expanded targeting space. Science. Sep. 21, 2018;361(6408):1259-1262. doi: 10.1126/science.aas9129. Epub Aug. 30, 2018.

Nomura et al., Controlling Mammalian Gene Expression by Allosteric Hepatitis Delta Virus Ribozymes. ACS Synth Biol. Dec. 20, 2013;2(12):684-9. doi: 10.1021/sb400037a. Epub May 22, 2013.

Nomura et al., Synthetic mammalian riboswitches based on guanine aptazyme. Chem Commun (Camb). Jul. 21, 2012;48(57):7215-7. doi: 10.1039/c2cc33140c. Epub Jun. 13, 2012.

Noris et al., A phenylalanine-55 to serine amino-acid substitution in the human glycoprotein IX leucine-rich repeat is associated with Bernard-Soulier syndrome. Br J Haematol. May 1997;97(2):312-20.

Nottingham et al., RNA-seq of human reference RNA samples using a thermostable group II intron reverse transcriptase. RNA. Apr. 2016;22(4):597-613. doi: 10.1261/rna.055558.115. Epub Jan. 29, 2016.

Nowak et al., Guide RNA Engineering for Versatile Cas9 Functionality. Nucleic Acids Res. Nov. 16, 2016;44(20):9555-9564. doi: 10.1093/nar/gkw908. Epub Oct. 12, 2016.

Nowak et al., Structural analysis of monomeric retroviral reverse transcriptase in complex with an RNA/DNA hybrid. Nucleic Acids Res. Apr. 1, 2013;41(6):3874-87. doi: 10.1093/nar/gkt053. Epub Feb. 4, 2013.

Numrych et al., A comparison of the effects of single-base and triple-base changes in the integrase arm-type binding sites on the site-specific recombination of bacteriophage lambda. Nucleic Acids Res. Jul. 11, 1990;18(13):3953-9. doi: 10.1093/nar/18.13.3953.

Nyerges et al., A highly precise and portable genome engineering method allows comparison of mutational effects across bacterial species. Proc Natl Acad Sci U S A. Mar. 1, 2016;113(9):2502-7. doi: 10.1073/pnas.1520040113. Epub Feb. 16, 2016.

Oakes et al., CRISPR-Cas9 Circular Permutants as Programmable Scaffolds for Genome Modification. Cell. Jan. 10, 2019;176(1-2):254-267.e16. doi: 10.1016/j.cell.2018.11.052.

Oakes et al., Protein engineering of Cas9 for enhanced function. Methods Enzymol. 2014;546:491-511.

O'Connell et al., Programmable RNA recognition and cleavage by CRISPR/Cas9. Nature. Dec. 11, 2014;516(7530):263-6. doi: 10.1038/nature13769. Epub Sep. 28, 2014.

Odsbu et al., Specific N-terminal interactions of the *Escherichia coli* SeqA protein are required to form multimers that restrain negative supercoils and form foci. Genes Cells. Nov. 2005;10(11):1039-49.

Oeemig et al., Solution structure of DnaE intein from Nostoc punctiforme: structural basis for the design of a new split intein suitable for site-specific chemical modification. FEBS Lett. May 6, 2009;583(9):1451-6.

Offord, Advances in Genome Editing. The Scientist, Apr. 20, 2016. http://www.the-scientist.com/?articles.view/articleNo/45903/title/Advances-in-Genome-Editing/.

Oh et al., Positional cloning of a gene for Hermansky-Pudlak syndrome, a disorder of cytoplasmic organelles. Nat Genet. Nov. 1996;14(3):300-6. doi: 10.1038/ng1196-300.

Ohe et al., Purification and properties of xanthine dehydrogenase from Streptomyces cyanogenus. J Biochem. Jul. 1979;86(1):45-53.

O'Maille et al., Structure-based combinatorial protein engineering (SCOPE). J Mol Biol. Aug. 23, 2002;321(4):677-91.

Orlando et al., Zinc-finger nuclease-driven targeted integration into mammalian genomes using donors with limited chromosomal homology. Nucleic Acids Res. Aug. 2010;38(15):e152.doi: 10.1093/nar/gkq512. Epub Jun. 8, 2010.

Orthwein et al., A mechanism for the suppression of homologous recombination in G1 cells. Nature. Dec. 17, 2015;528(7582):422-6. doi: 10.1038/nature16142. Epub Dec. 9, 2015.

Osborn et al., TALEN-based gene correction for epidermolysis bullosa. Mol Ther. Jun. 2013;21(6):1151-9. doi: 10.1038/mt.2013.56. Epub Apr. 2, 2013.

Ostermeier et al., A combinatorial approach to hybrid enzymes independent of DNA homology. Nat Biotechnol. Dec. 1999;17(12):1205-9.

Otto et al., The probability of fixation in populations of changing size. Genetics. Jun. 1997;146(2):723-33.

Paige et al., RNA mimics of green fluorescent protein. Science. Jul. 29, 2011;333(6042):642-6. doi:10.1126/science.1207339.

Pan et al., Biological and biomedical applications of engineered nucleases. Mol Biotechnol. Sep. 2013;55(1):54-62. doi: 10.1007/s12033-012-9613-9.

Paquet et al., Efficient introduction of specific homozygous and heterozygous mutations using CRISPR/Cas9. Nature. May 5, 2016;533(7601):125-9. doi: 10.1038/nature17664. Epub Apr. 27, 2016.

Park et al., Digenome-seq web tool for profiling CRISPR specificity. Nat Methods. May 30, 2017;14(6):548-549. doi: 10.1038/nmeth.4262.

Park et al., Highly efficient editing of the ?-globin gene in patient-derived hematopoietic stem and progenitor cells to treat sickle cell disease. Nucleic Acids Res. Sep. 5, 2019;47(15):7955-7972. doi: 10.1093/nar/gkz475.

Park et al., Sendai virus, an RNA virus with no risk of genomic integration, delivers CRISPR/Cas9 for efficient gene editing. Mol Ther Methods Clin Dev. Aug. 24, 2016;3:16057. doi: 10.1038/mtm.2016.57.

(56) References Cited

OTHER PUBLICATIONS

Parker et al., Admixture mapping identifies a quantitative trait locus associated with FEV1/FVC in the COPDGene Study. Genet Epidemiol. Nov. 2014;38(7):652-9. doi: 10.1002/gepi.21847. Epub Aug. 11, 2014.

Patel et al., Flap endonucleases pass 5'-flaps through a flexible arch using a disorder-thread-order mechanism to confer specificity for free 5'-ends. Nucleic Acids Res. May 2012;40(10):4507-19. doi: 10.1093/nar/gks051. Epub Feb. 8, 2012.

Pattanayak et al., Determining the specificities of TALENs, Cas9, and other genome-editing enzymes. Methods Enzymol. 2014;546:47-78. doi: 10.1016/B978-0-12-801185-0.00003-9.

Pattanayak et al., High-throughput profiling of off-target DNA cleavage reveals RNA-programmed Cas9 nuclease specificity. Nat Biotechnol. Sep. 2013;31(9):839-43. doi: 10.1038/nbt.2673. Epub Aug. 11, 2013.

Pattanayak et al., Revealing off-target cleavage specificities of zinc-finger nucleases by in vitro selection. Nat Methods. Aug. 7, 2011;8(9):765-70. doi: 10.1038/nmeth.1670.

Pavletich et al., Zinc finger-DNA recognition: crystal structure of a Zif268-DNA complex at 2.1 A. Science. May 10, 1991;252(5007):809-17.

Pawson et al., Protein phosphorylation in signaling—50 years and counting. Trends Biochem Sci. Jun. 2005;30(6):286-90. doi: 10.1016/j.tibs.2005.04.013.

Pearl, Structure and function in the uracil-DNA glycosylase superfamily. Mutat Res. Aug. 30, 2000;460(3-4):165-81.

Peck et al., Directed evolution of a small-molecule-triggered intein with improved splicing properties in mammalian cells. Chem Biol. May 27, 2011;18(5):619-30. doi: 10.1016/j.chembiol.2011.02.014.

Pellenz et al., New human chromosomal safe harbor sites for genome engineering with CRISPR/Cas9, TAL effector and homing endonucleases. Aug. 20, 2018. bioRxiv doi: https://doi.org/10.1101/396390.

Pelletier, CRISPR-Cas systems for the study of the immune function. Nov. 15, 2016. https://doi.org/10.1002/9780470015902.a0026896.

Pennisi et al., The CRISPR craze. Science. Aug. 23, 2013;341(6148):833-6. doi: 10.1126/science.341.6148.833.

Pennisi et al., The tale of the TALEs. Science. Dec. 14, 2012;338(6113):1408-11. doi: 10.1126/science.338.6113.1408.

Perach et al., Catalytic features of the recombinant reverse transcriptase of bovine leukemia virus expressed in bacteria. Virology. Jun. 20, 1999;259(1):176-89. doi: 10.1006/viro.1999.9761.

Perez et al., Establishment of HIV-1 resistance in CD4+ T cells by genome editing using zinc-finger nucleases. Nat Biotechnol. Jul. 2008;26(7):808-16. Doi: 10.1038/nbt1410. Epub Jun. 29, 2008.

Perez-Pinera et al., Advances in targeted genome editing. Curr Opin Chem Biol. Aug. 2012;16(3-4):268-77. doi: 10.1016/j.cbpa.2012.06.007. Epub Jul. 20, 2012.

Perez-Pinera et al., RNA-guided gene activation by CRISPR-Cas9-based transcription factors. Nat Methods. Oct. 2013;10(10):973-6. doi: 10.1038/nmeth.2600. Epub Jul. 25, 2013.

Perler et al., Protein splicing elements: inteins and exteins—a definition of terms and recommended nomenclature. Nucleic Acids Res. Apr. 11, 1994;22(7):1125-7. doi: 10.1093/nar/22.7.1125.

Perler, InBase, the New England Biolabs Intein Database. Nucleic Acids Res. Jan. 1, 1999;27(1):346-7. doi: 10.1093/nar/27.1.346.

Perler, Protein splicing of inteins and hedgehog autoproteolysis: structure, function, and evolution. Cell. Jan. 9, 1998;92(1):1-4. doi: 10.1016/s0092-8674(00)80892-2.

Petek et al., Frequent endonuclease cleavage at off-target locations in vivo. Mol Ther. May 2010;18(5):983-6. Doi: 10.1038/mt.2010.35. Epub Mar. 9, 2010.

Petersen-Mahrt et al., AID mutates *E. coli* suggesting a DNA deamination mechanism for antibody diversification. Nature. Jul. 4, 2002;418(6893):99-103.

Petolino et al., Editing Plant Genomes: a new era of crop improvement. Plant Biotechnol J. Feb. 2016;14(2):435-6. doi: 10.1111/pbi.12542.

Peyrottes et al., Oligodeoxynucleoside phosphoramidates (P-NH2): synthesis and thermal stability of duplexes with DNA and RNA targets. Nucleic Acids Res. May 15, 1996;24(10):1841-8.

Pfeiffer et al., Mechanisms of DNA double-strand break repair and their potential to induce chromosomal aberrations. Mutagenesis. Jul. 2000;15(4):289-302. doi: 10.1093/mutage/15.4.289.

Phillips, The challenge of gene therapy and DNA delivery. J Pharm Pharmacol. Sep. 2001;53(9):1169-74.

Pickart et al., Ubiquitin: structures, functions, mechanisms. Biochim Biophys Acta. Nov. 29, 2004;1695(1-3):55-72. doi: 10.1016/j.bbamcr.2004.09.019.

Pinkert et al., An albumin enhancer located 10 kb upstream functions along with its promoter to direct efficient, liver-specific expression in transgenic mice. Genes Dev. May 1987;1(3):268-76. doi: 10.1101/gad.1.3.268.

Pirakitikulr et al., PCRless library mutagenesis via oligonucleotide recombination in yeast. Protein Sci. Dec. 2010;19(12):2336-46. doi: 10.1002/pro.513.

Plasterk et al., DNA inversions in the chromosome of *Escherichia coli* and in bacteriophage Mu: relationship to other site-specific recombination systems. Proc Natl Acad Sci U S A. Sep. 1983;80(17):5355-8.

Plosky et al., CRISPR-Mediated Base Editing without DNA Double-Strand Breaks. Mol Cell. May 19, 2016;62(4):477-8. doi: 10.1016/j.molcel.2016.05.006.

Pluciennik et al., PCNA function in the activation and strand direction of MutL? endonuclease in mismatch repair. Proc Natl Acad Sci U S A. Sep. 14, 2010;107(37):16066-71. doi: 10.1073/pnas.1010662107. Epub Aug. 16, 2010.

Poller et al., A leucine-to-proline substitution causes a defective alpha 1-antichymotrypsin allele associated with familial obstructive lung disease. Genomics. Sep. 1993;17(3):740-3.

Porteus, Design and testing of zinc finger nucleases for use in mammalian cells. Methods Mol Biol. 2008;435:47-61. doi: 10.1007/978-1-59745-232-8_4.

Posnick et al., Imbalanced base excision repair increases spontaneous mutation and alkylation sensitivity in *Escherichia coli*. J Bacteriol. Nov. 1999;181(21):6763-71.

Pospísilová et al., Hydrolytic cleavage of N6-substituted adenine derivatives by eukaryotic adenine and adenosine deaminases. Biosci Rep. 2008;28(6):335-347. doi:10.1042/BSR20080081.

Pourcel et al., CRISPR elements in Yersinia pestis acquire new repeats by preferential uptake of bacteriophage DNA, and provide additional tools for evolutionary studies. Microbiology. Mar. 2005;151(Pt 3):653-63.

Prashant et al., CAS9 transcriptional activators for target specificity screening and paired nickases for cooperative genome engineering. Nature Biotechnology 2013;31(9):833-8.

Prorocic et al., Zinc-finger recombinase activities in vitro. Nucleic Acids Res. Nov. 2011;39(21):9316-28. doi: 10.1093/nar/gkr652. Epub Aug. 17, 2011.

Proudfoot et al., Zinc finger recombinases with adaptable DNA sequence specificity. PLoS One. Apr. 29, 2011;6(4):e19537. doi: 10.1371/journal.pone.0019537.

Prykhozhij et al., CRISPR multitargeter: a web tool to find common and unique CRISPR single guide RNA targets in a set of similar sequences. PLoS One. Mar. 5, 2015;10(3):e0119372. doi: 10.1371/journal.pone.0119372. eCollection 2015.

Pu et al., Evolution of a split RNA polymerase as a versatile biosensor platform. Nat Chem Biol. Apr. 2017;13(4):432-438. doi: 10.1038/nchembio.2299. Epub Feb. 13, 2017.

Putnam et al., Protein mimicry of DNA from crystal structures of the uracil-DNA glycosylase inhibitor protein and its complex with *Escherichia coli* uracil-DNA glycosylase. J Mol Biol. Mar. 26, 1999;287(2):331-46.

Qi et al., Engineering naturally occurring trans-acting non-coding RNAs to sense molecular signals. Nucleic Acids Res. Jul. 2012;40(12):5775-86. doi: 10.1093/nar/gks168. Epub Mar. 1, 2012.

Qi et al., Repurposing CRISPR as an RNA-guided platform for sequence-specific control of gene expression. Cell. Feb. 28, 2013;152(5):1173-83. doi: 10.1016/j.cell.2013.02.022.

(56) References Cited

OTHER PUBLICATIONS

Qu et al., Global mapping of binding sites for phic31 integrase in transgenic maden-darby bovine kidney cells using ChIP-seq. Hereditas. Jan. 14, 2019;156:3. doi: 10.1186/s41065-018-0079-z.

Radany et al., Increased spontaneous mutation frequency in human cells expressing the phage PBS2-encoded inhibitor of uracil-DNA glycosylase. Mutat Res. Sep. 15, 2000;461(1):41-58. doi: 10.1016/s0921-8777(00)00040-9.

Rakonjac et al., Roles of PIII in filamentous phage assembly. J Mol Biol. 1998; 282(1)25-41.

Ramakrishna et al., Gene disruption by cell-penetrating peptide-mediated delivery of Cas9 protein and guide RNA. Genome Res. Jun. 2014;24(6):1020-7. doi: 10.1101/gr.171264.113. Epub Apr. 2, 2014.

Ramirez et al., Engineered zinc finger nickases induce homology-directed repair with reduced mutagenic effects. Nucleic Acids Res. Jul. 2012;40(12):5560-8. doi: 10.1093/nar/gks179. Epub Feb. 28, 2012.

Ramirez et al., Unexpected failure rates for modular assembly of engineered zinc fingers. Nat Methods. May 2008;5(5):374-5. Doi: 10.1038/nmeth0508-374.

Ran et al., Double Nicking by RNA-guided CRISPR Cas9 for Enhanced Genome Editing Specificity. Cell. Sep. 12, 2013;154(6):1380-9. doi: 10.1016/j.cell.2013.08.021. Epub Aug. 29, 2013.

Ran et al., Genome engineering using the CRISPR-Cas9 system. Nat Protoc. Nov. 2013;8(11):2281-308. doi: 10.1038/nprot.2013.143. Epub Oct. 24, 2013.

Ran et al., In vivo genome editing using *Staphylococcus aureus* Cas9. Nature. Apr. 9, 2015;520(7546):186-91. doi: 10.1038/nature14299. Epub Apr. 1, 2015.

Ranzau et al., Genome, Epigenome, and Transcriptome Editing via Chemical Modification of Nucleobases in Living Cells. Biochemistry. Feb. 5, 2019;58(5):330-335. doi: 10.1021/acs.biochem.8b00958. Epub Dec. 12, 2018.

Rasila et al., Critical evaluation of random mutagenesis by error-prone polymerase chain reaction protocols, *Escherichia coli* mutator strain, and hydroxylamine treatment. Anal Biochem. May 1, 2009;388(1):71-80. doi: 10.1016/j.ab.2009.02.008. Epub Feb. 10, 2009.

Raskin et al., Substitution of a single bacteriophage T3 residue in bacteriophage T7 RNA polymerase at position 748 results in a switch in promoter specificity. J Mol Biol. Nov. 20, 1992;228(2):506-15.

Raskin et al., T7 RNA polymerase mutants with altered promoter specificities. Proc Natl Acad Sci U S A. Apr. 15, 1993;90(8):3147-51.

Rath et al., Fidelity of end joining in mammalian episomes and the impact of Metnase on joint processing. BMC Mol Biol. Mar. 22, 2014;15:6. doi: 10.1186/1471-2199-15-6.

Rauch et al., Programmable RNA Binding Proteins for Imaging and Therapeutics. Biochemistry. Jan. 30, 2018;57(4):363-364. doi: 10.1021/acs.biochem.7b01101. Epub Nov. 17, 2017.

Ravishankar et al., X-ray analysis of a complex of *Escherichia coli* uracil DNA glycosylase (EcUDG) with a proteinaceous inhibitor. The structure elucidation of a prokaryotic UDG. Nuclei Acids Res. 26 (21): 4880-4887 (1998).

Ray et al., A compendium of RNA-binding motifs for decoding gene regulation. Nature. Jul. 11, 2013;499(7457):172-7. doi: 10.1038/nature12311.

Ray et al., Homologous recombination: ends as the means. Trends Plant Sci. Oct. 2002;7(10):435-40.

Rebar et al., Phage display methods for selecting zinc finger proteins with novel DNA-binding specificities. Methods Enzymol. 1996;267:129-49.

Rebuzzini et al., New mammalian cellular systems to study mutations introduced at the break site by non-homologous end-joining. DNA Repair (Amst). May 2, 2005;4(5):546-55.

Rees et al., Analysis and minimization of cellular RNA editing by DNA adenine base editors. Sci Adv. May 8, 2019;5(5):eaax5717. doi: 10.1126/sciadv.aax5717.

Rees et al., Base editing: precision chemistry on the genome and transcriptome of living cells. Nat Rev Genet. Dec. 2018;19(12):770-788. doi: 10.1038/s41576-018-0059-1.

Rees et al., Development of hRad51-Cas9 nickase fusions that mediate HDR without double-stranded breaks. Nat Commun. May 17, 2019;10(1):2212. doi: 10.1038/s41467-019-09983-4.

Rees et al., Improving the DNA specificity and applicability of base editing through protein engineering and protein delivery. Nat Commun. Jun. 6, 2017;8:15790. doi: 10.1038/ncomms15790.

Relph et al., Recent developments and current status of gene therapy using viral vectors in the United Kingdom. BMJ. 2004;329(7470):839-842. doi:10.1136/bmj.329.7470.839.

Ren et al., In-line Alignment and $Mg^{2+}$ Coordination at the Cleavage Site of the env22 Twister Ribozyme. Nat Commun. Nov. 20, 2014;5:5534. doi: 10.1038/ncomms6534.

Ren et al., Pistol Ribozyme Adopts a Pseudoknot Fold Facilitating Site-Specific In-Line Cleavage. Nat Chem Biol. Sep. 2016;12(9):702-8. doi: 10.1038/nchembio.2125. Epub Jul. 11, 2016.

Reyon et al., FLASH assembly of TALENs for high-throughput genome editing. Nat Biotechnol. May 2012;30(5):460-5. doi: 10.1038/nbt.2170.

Ribeiro et al., Protein Engineering Strategies to Expand CRISPR-Cas9 Applications. Int J Genomics. Aug. 2, 2018;2018:1652567. doi: 10.1155/2018/1652567.

Richardson et al., Enhancing homology-directed genome editing by catalytically active and inactive CRISPR-Cas9 using asymmetric donor DNA. Nat Biotechnol. Mar. 2016;34(3):339-44. doi: 10.1038/nbt.3481. Epub Jan. 20, 2016.

Richter et al., Function and regulation of clustered regularly interspaced short palindromic repeats (CRISPR) / CRISPR associated (Cas) systems. Viruses. Oct. 19, 2012;4(10):2291-311. doi: 10.3390/v4102291.

Riechmann et al.,. The C-terminal domain of TolA is the coreceptor for filamentous phage infection of *E. coli*. Cell. 1997; 90(2):351-60. PMID:9244308.

Ringrose et al., The Kw recombinase, an integrase from Kluyveromyces waltii. Eur J Biochem. Sep. 15, 1997;248(3):903-12. doi: 10.1111/j.1432-1033.1997.00903.x.

Rogozin et al., Evolution and diversification of lamprey antigen receptors: evidence for involvement of an AID-APOBEC family cytosine deaminase. Nat Immunol. Jun. 2007;8(6):647-56. doi: 10.1038/ni1463. Epub Apr. 29, 2007.

Rong et al., Homologous recombination in human embryonic stem cells using CRISPR/Cas9 nickase and a long DNA donor template. Protein Cell. Apr. 2014;5(4):258-60. doi: 10.1007/s13238-014-0032-5.

Roth et al., A widespread self-cleaving ribozyme class is revealed by bioinformatics. Nat Chem Biol. Jan. 2014;10(1):56-60. doi: 10.1038/nchembio.1386. Epub Nov. 17, 2013.

Roth et al., Purification and characterization of murine retroviral reverse transcriptase expressed in *Escherichia coli*. J Biol Chem. Aug. 5, 1985;260(16):9326-35.

Rouet et al., Expression of a site-specific endonuclease stimulates homologous recombination in mammalian cells. Proc Natl Acad Sci U S A. Jun. 21, 1994;91(13):6064-8. doi: 10.1073/pnas.91.13.6064.

Rouet et al., Introduction of double-strand breaks into the genome of mouse cells by expression of a rare-cutting endonuclease. Mol Cell Biol. Dec. 1994;14(12):8096-106. doi: 10.1128/mcb.14.12.8096.

Rouet et al., Receptor-Mediated Delivery of CRISPR-Cas9 Endonuclease for Cell-Type-Specific Gene Editing. J Am Chem Soc. May 30, 2018;140(21):6596-6603. doi: 10.1021/jacs.8b01551. Epub May 18, 2018.

Roundtree et al.,YTHDC1 mediates nuclear export of N6-methyladenosine methylated mRNAs. Elife. Oct. 6, 2017;6:e31311. doi: 10.7554/eLife.31311.

Rowland et al., Regulatory mutations in Sin recombinase support a structure-based model of the synaptosome. Mol Microbiol. Oct. 2009;74(2):282-98. doi: 10.1111/j.1365-2958.2009.06756.x. Epub Jun. 8, 2009.

Rowland et al., Sin recombinase from *Staphylococcus aureus*: synaptic complex architecture and transposon targeting. Mol Microbiol. May 2002;44(3):607-19. doi: 10.1046/j.1365-2958.2002.02897.x.

(56) References Cited

OTHER PUBLICATIONS

Rubio et al., An adenosine-to-inosine tRNA-editing enzyme that can perform C-to-U deamination of DNA. Proc Natl Acad Sci U S A. May 8, 2007;104(19):7821-6. doi: 10.1073/pnas.0702394104. Epub May 1, 2007. PMID: 17483465; PMCID: PMC1876531.

Rudolph et al., Synthetic riboswitches for the conditional control of gene expression in Streptomyces coelicolor. Microbiology. Jul. 2013;159(Pt 7):1416-22. doi: 10.1099/mic.0.067322-0. Epub May 15, 2013.

Rüfer et al., Non-contact positions impose site selectivity on Cre recombinase. Nucleic Acids Res. Jul. 1, 2002;30(13):2764-71. doi: 10.1093/nar/gkf399.

Rutherford et al., Attachment site recognition and regulation of directionality by the serine integrases. Nucleic Acids Res. Sep. 2013;41(17):8341-56. doi: 10.1093/nar/gkt580. Epub Jul. 2, 2013.

Sadelain et al., Safe harbours for the integration of new DNA in the human genome. Nat Rev Cancer. Dec. 1, 2011;12(1):51-8. doi: 10.1038/nrc3179.

Sage et al., Proliferation of functional hair cells in vivo in the absence of the retinoblastoma protein. Science. Feb. 18, 2005;307(5712):1114-8. Epub Jan. 13, 2005.

Sakuma et al., MMEJ-assisted gene knock-in using TALENs and CRISPR-Cas9 with the PITCh systems. Nat Protoc. Jan. 2016;11(1):118-33. doi: 10.1038/nprot.2015.140. Epub Dec. 17, 2015.

Saleh-Gohari et al., Conservative homologous recombination preferentially repairs DNA double-strand breaks in the S phase of the cell cycle in human cells. Nucleic Acids Res. Jul. 13, 2004;32(12):3683-8. Print 2004.

Samal et al., Cationic polymers and their therapeutic potential. Chem Soc Rev. Nov. 7, 2012;41(21):7147-94. doi: 10.1039/c2cs35094g. Epub Aug. 10, 2012.

Samulski et al., Helper-free stocks of recombinant adeno-associated viruses: normal integration does not require viral gene expression. J Virol. Sep. 1989;63(9):3822-8. doi: 10.1128/JVI.63.9.3822-3828.1989.

Sander et al., CRISPR-Cas systems for editing, regulating and targeting genomes. Nat Biotechnol. Apr. 2014;32(4):347-55. doi: 10.1038/nbt.2842. Epub Mar. 2, 2014.

Sander et al., In silico abstraction of zinc finger nuclease cleavage profiles reveals an expanded landscape of off-target sites. Nucleic Acids Res. Oct. 2013;41(19):e181. doi: 10.1093/nar/gkt716. Epub Aug. 14, 2013.

Sander et al., Targeted gene disruption in somatic zebrafish cells using engineered TALENs. Nat Biotechnol. Aug. 5, 2011;29(8):697-8. doi: 10.1038/nbt.1934.

Sang, Prospects for transgenesis in the chick. Mech Dev. Sep. 2004;121(9):1179-86.

Sanjana et al., A transcription activator-like effector toolbox for genome engineering. Nat Protoc. Jan. 5, 2012;7(1):171-92. doi: 10.1038/nprot.2011.431.

Santiago et al., Targeted gene knockout in mammalian cells by using engineered zinc-finger nucleases. Proc Natl Acad Sci U S A. Apr. 15, 2008;105(15):5809-14. doi: 10.1073/pnas.0800940105. Epub Mar. 21, 2008.

Santoro et al., Directed evolution of the site specificity of Cre recombinase. Proc Natl Acad Sci U S A. Apr. 2, 2002;99(7):4185-90. Epub Mar. 19, 2002.

Saparbaev et al., Excision of hypoxanthine from DNA containing dIMP residues by the *Escherichia coli*, yeast, rat, and human alkylpurine DNA glycosylases. Proc Natl Acad Sci U S A. Jun. 21, 1994;91(13):5873-7. doi: 10.1073/pnas.91.13.5873.

Sapranauskas et al., The *Streptococcus thermophilus* CRISPR/Cas system provides immunity in *Escherichia coli*. Nucleic Acids Res. Nov. 2011;39(21):9275-82. doi: 10.1093/nar/gkr606. Epub Aug. 3, 2011.

Saraconi et al., The RNA editing enzyme APOBEC1 induces somatic mutations and a compatible mutational signature is present in esophageal adenocarcinomas. Genome Biol. Jul. 31, 2014;15(7):417. doi: 10.1186/s13059-014-0417-z.

Sashital et al., Mechanism of foreign DNA selection in a bacterial adaptive immune system. Mol Cell. Jun. 8, 2012;46(5):606-15. doi: 10.1016/j.molcel.2012.03.020. Epub Apr. 19, 2012.

Sasidharan et al., The selection of acceptable protein mutations. PNAS; Jun. 12, 2007;104(24):10080-5. www.pnas.org/cgi/doi/10.1073.pnas.0703737104.

Satomura et al., Precise genome-wide base editing by the CRISPR Nickase system in yeast. Sci Rep. May 18, 2017;7(1):2095. doi: 10.1038/s41598-017-02013-7.

Saudek et al., A preliminary trial of the programmable implantable medication system for insulin delivery. N Engl J Med. Aug. 31, 1989;321(9):574-9.

Sauer et al., DNA recombination with a heterospecific Cre homolog identified from comparison of the pac-c1 regions of P1-related phages. Nucleic Acids Res. Nov. 18, 2004;32(20):6086-95. doi: 10.1093/nar/gkh941.

Schaaper et al., Base selection, proofreading, and mismatch repair during DNA replication in *Escherichia coli*. J Biol Chem. Nov. 15, 1993;268(32):23762-5.

Schaaper et al., Spectra of spontaneous mutations in *Escherichia coli* strains defective in mismatch correction: the nature of in vivo DNA replication errors. Proc Natl Acad Sci U S A. Sep. 1987;84(17):6220-4.

Schaefer et al., Understanding RNA modifications: the promises and technological bottlenecks of the 'epitranscriptome'. Open Biol. May 2017;7(5):170077. doi: 10.1098/rsob.170077.

Schechner et al., Multiplexable, locus-specific targeting of long RNAs with CRISPR-Display. Nat Methods. Jul. 2015;12(7):664-70. doi: 10.1038/nmeth.3433. Epub Jun. 1, 2015.

Schek et al., Definition of the upstream efficiency element of the simian virus 40 late polyadenylation signal by using in vitro analyses. Mol Cell Biol. Dec. 1992;12(12):5386-93. doi: 10.1128/mcb.12.12.5386.

Schenk et al., MPDU1 mutations underlie a novel human congenital disorder of glycosylation, designated type If. J Clin Invest. Dec. 2001;108(11):1687-95. doi: 10.1172/JCI13419.

Schmitz et al., Behavioral abnormalities in prion protein knockout mice and the potential relevance of PrP(C) for the cytoskeleton. Prion. 2014;8(6):381-6. doi: 10.4161/19336896.2014.983746.

Schöller et al., Interactions, localization, and phosphorylation of the m6A generating METTL3-METTL14-WTAP complex. RNA. Apr. 2018;24(4):499-512. doi: 10.1261/rna.064063.117. Epub Jan. 18, 2018.

Schriefer et al., Low pressure DNA shearing: a method for random DNA sequence analysis. Nucleic Acids Res. Dec. 25, 1990;18(24):7455-6.

Schultz et al., Oligo-2'-fluoro-2'-deoxynucleotide N3'-->P5' phosphoramidates: synthesis and properties. Nucleic Acids Res. Aug. 1, 1996;24(15):2966-73.

Schwank et al., Functional repair of CFTR by CRISPR/Cas9 in intestinal stem cell organoids of cystic fibrosis patients. Cell Stem Cell. Dec. 5, 2013;13(6):653-8. doi:10.1016/j.stem.2013.11.002.

Schwartz et al., Post-translational enzyme activation in an animal via optimized conditional protein splicing. Nat Chem Biol. Jan. 2007;3(1):50-4. Epub Nov. 26, 2006.

Schwarze et al., In vivo protein transduction: delivery of a biologically active protein into the mouse. Science. Sep. 3, 1999;285(5433):1569-72.

Sclimenti et al., Directed evolution of a recombinase for improved genomic integration at a native human sequence. Nucleic Acids Res. Dec. 15, 2001;29(24):5044-51.

Scott et al., Production of cyclic peptides and proteins in vivo. Proc Natl Acad Sci U S A. Nov. 23, 1999;96(24):13638-43. doi: 10.1073/pnas.96.24.13638.

Sebastián-Martín et al., Transcriptional inaccuracy threshold attenuates differences in RNA-dependent DNA synthesis fidelity between retroviral reverse transcriptases. Sci Rep. Jan. 12, 2018;8(1):627. doi: 10.1038/s41598-017-18974-8.

Sefton et al., Implantable pumps. Crit Rev Biomed Eng. 1987;14(3):201-40.

(56) References Cited

OTHER PUBLICATIONS

Segal et al., Toward controlling gene expression at will: selection and design of zinc finger domains recognizing each of the 5'-GNN-3' DNA target sequences. Proc Natl Acad Sci U S A. Mar. 16, 1999;96(6):2758-63.

Sells et al., Delivery of protein into cells using polycationic liposomes. Biotechniques. Jul. 1995;19(1):72-6, 78.

Semenova et al., Interference by clustered regularly interspaced short palindromic repeat (CRISPR) RNA is governed by a seed sequence. Proc Natl Acad Sci U S A. Jun. 21, 2011;108(25):10098-103. doi: 10.1073/pnas.1104144108. Epub Jun. 6, 2011.

Semple et al., Rational design of cationic lipids for siRNA delivery. Nat Biotechnol. Feb. 2010;28(2):172-6. doi: 10.1038/nbt.1602. Epub Jan. 17, 2010.

Serganov et al., Coenzyme recognition and gene regulation by a flavin mononucleotide riboswitch. Nature. Mar. 12, 2009;458(7235):233-7. doi: 10.1038/nature07642. Epub Jan. 25, 2009.

Serganov et al., Structural basis for discriminative regulation of gene expression by adenine- and guanine-sensing mRNAs. Chem Biol. Dec. 2004;11(12):1729-41.

Serganov et al., Structural basis for gene regulation by a thiamine pyrophosphate-sensing riboswitch. Nature. Jun. 29, 2006;441(7097):1167-71. Epub May 21, 2006.

Seripa et al., The missing ApoE allele. Ann Hum Genet. Jul. 2007;71(Pt 4):496-500. Epub Jan. 22, 2007.

Serrano-Heras et al., Protein p56 from the Bacillus subtilis phage phi29 inhibits DNA-binding ability of uracil-DNA glycosylase. Nucleic Acids Res. 2007;35(16):5393-401. Epub Aug. 13, 2007.

Severinov et al., Expressed protein ligation, a novel method for studying protein-protein interactions in transcription. J Biol Chem. Jun. 26, 1998;273(26):16205-9. doi: 10.1074/jbc.273.26.16205.

Shah et al., Inteins: nature's gift to protein chemists. Chem Sci. 2014;5(1):446-461.

Shah et al., Kinetic control of one-pot trans-splicing reactions by using a wild-type and designed split intein. Angew Chem Int Ed Engl. Jul. 11, 2011;50(29):6511-5. doi: 10.1002/anie.201102909. Epub Jun. 8, 2011.

Shah et al., Protospacer recognition motifs: mixed identities and functional diversity. RNA Biol. May 2013;10(5):891-9. doi: 10.4161/rna.23764. Epub Feb. 12, 2013.

Shah et al., Target-specific variants of Flp recombinase mediate genome engineering reactions in mammalian cells. FEBS J. Sep. 2015;282(17):3323-33. doi: 10.1111/febs.13345. Epub Jul. 1, 2015.

Shalem et al., High-throughput functional genomics using CRISPR-Cas9. Nat Rev Genet. May 2015;16(5):299-311. doi: 10.1038/nrg3899. Epub Apr. 9, 2015.

Shalem et al., Genome-scale CRISPR-Cas9 knockout screening in human cells. Science. Jan. 3, 2014;343(6166):84-7. doi: 10.1126/science.1247005. Epub Dec. 12, 2013.

Sharbeen et al., Ectopic restriction of DNA repair reveals that UNG2 excises AID-induced uracils predominantly or exclusively during G1 phase. J Exp Med. May 7, 2012;209(5):965-74. doi: 10.1084/jem.20112379. Epub Apr. 23, 2012.

Sharer et al., The ARF-like 2 (ARL2)-binding protein, BART. Purification, cloning, and initial characterization. J Biol Chem. Sep. 24, 1999;274(39):27553-61. doi: 10.1074/jbc.274.39.27553.

Sharma et al., Efficient introduction of aryl bromide functionality into proteins in vivo. FEBS Lett. Feb. 4, 2000;467(1):37-40.

Sharon et al., Functional Genetic Variants Revealed by Massively Parallel Precise Genome Editing. Cell. Oct. 4, 2018;175(2):544-557.e16. doi: 10.1016/j.cell.2018.08.057. Epub Sep. 20, 2018.

Shaw et al., Implications of human genome architecture for rearrangement-based disorders: the genomic basis of disease. Hum Mol Genet. Apr. 1, 2004;13 Spec No. 1:R57-64. doi: 10.1093/hmg/ddh073. Epub Feb. 5, 2004.

Shcherbakova et al., Near-infrared fluorescent proteins for multicolor in vivo imaging. Nat Methods. Aug. 2013;10(8):751-4. doi: 10.1038/nmeth.2521. Epub Jun. 16, 2013.

Shee et al., Engineered proteins detect spontaneous DNA breakage in human and bacterial cells. Elife. Oct. 29, 2013;2:e01222. doi: 10.7554/eLife.01222.

Shen et al., Predictable and precise template-free CRISPR editing of pathogenic variants. Nature. Nov. 2018;563(7733):646-651. doi: 10.1038/s41586-018-0686-x. Epub Nov. 7, 2018. Erratum in: Nature. Mar. 2019;567(7746):E1-E2.

Sheridan, First CRISPR-Cas patent opens race to stake out intellectual property. Nat Biotechnol. 2014;32(7):599-601.

Sheridan, Gene therapy finds its niche. Nat Biotechnol. Feb. 2011;29(2):121-8. doi: 10.1038/nbt.1769.

Sherwood et al., Discovery of directional and nondirectional pioneer transcription factors by modeling DNase profile magnitude and shape. Nat Biotechnol. Feb. 2014;32(2):171-178. doi: 10.1038/nbt.2798. Epub Jan. 19, 2014.

Shi et al., Structural basis for targeted DNA cytosine deamination and mutagenesis by APOBEC3A and APOBEC3B. Nat Struct Mol Biol. Feb. 2017;24(2):131-139. doi: 10.1038/nsmb.3344. Epub Dec. 19, 2016.

Shi et al., YTHDF3 facilitates translation and decay of N6-methyladenosine-modified RNA. Cell Res. Mar. 2017;27(3):315-328. doi: 10.1038/cr.2017.15. Epub Jan. 20, 2017.

Shimantani et al., Targeted base editing in rice and tomato using a CRISPR-Cas9 cytidine deaminase fusion. Nat Biotechnol. May 2017;35(5):441-443. doi: 10.1038/nbt.3833. Epub Mar. 27, 2017.

Shimojima et al., Spinocerebellar ataxias type 27 derived from a disruption of the fibroblast growth factor 14 gene with mimicking phenotype of paroxysmal non-kinesigenic dyskinesia. Brain Dev. Mar. 2012;34(3):230-3. doi: 10.1016/j.braindev.2011.04.014. Epub May 19, 2011.

Shin et al., CRISPR/Cas9 targeting events cause complex deletions and insertions at 17 sites in the mouse genome. Nat Commun. May 31, 2017;8:15464. doi: 10.1038/ncomms15464.

Shindo et al., A Comparison of Two Single-Stranded DNA Binding Models by Mutational Analysis of APOBEC3G. Biology (Basel). Aug. 2, 2012;1(2):260-76. doi: 10.3390/biology1020260.

Shmakov et al., Discovery and Functional Characterization of Diverse Class 2 CRISPR Cas Systems. Molecular Cell Nov. 2015;60(3):385-97.

Shmakov et al., Diversity and evolution of class 2 CRISPR-Cas systems. Nat Rev Microbiol. Mar. 2017;15(3):169-182. doi: 10.1038/nrmicro.2016.184. Epub Jan. 23, 2017.

Shultz et al., A genome-wide analysis of FRT-like sequences in the human genome. PLoS One. Mar. 23, 2011;6(3):e18077. doi: 10.1371/journal.pone.0018077.

Siebert et al., An improved PCR method for walking in uncloned genomic DNA. Nucleic Acids Res. Mar. 25, 1995;23(6):1087-8.

Silas et al., Direct CRISPR spacer acquisition from RNA by a natural reverse transcriptase-Cas1 fusion protein. Science. Feb. 26, 2016;351(6276):aad4234. doi: 10.1126/science.aad4234.

Silva et al., Selective disruption of the DNA polymerase III α-β complex by the umuD gene products. Nucleic Acids Res. Jul. 2012;40(12):5511-22. doi: 10.1093/nar/gks229. Epub Mar. 9, 2012.

Simonelli et al., Base excision repair intermediates are mutagenic in mammalian cells. Nucleic Acids Res. Aug. 2, 2005;33(14):4404-11. Print 2005.

Singh et al., Cross-talk between diverse serine integrases. J Mol Biol. Jan. 23, 2014;426(2):318-31. doi: 10.1016/j.jmb.2013.10.013. Epub Oct. 22, 2013.

Sirk et al., Expanding the zinc-finger recombinase repertoire: directed evolution and mutational analysis of serine recombinase specificity determinants. Nucleic Acids Res. Apr. 2014;42(7):4755-66. doi: 10.1093/nar/gkt1389. Epub Jan. 21, 2014.

Sivalingam et al., Biosafety assessment of site-directed transgene integration in human umbilical cord-lining cells. Mol Ther. Jul. 2010;18(7):1346-56. doi: 10.1038/mt.2010.61. Epub Apr. 27, 2010.

Sjoblom et al., The consensus coding sequences of human breast and colorectal cancers. Science. Oct. 13, 2006;314(5797):268-74. Epub Sep. 7, 2006.

Skretas et al., Regulation of protein activity with small-molecule-controlled inteins. Protein Sci. Feb. 2005;14(2):523-32. Epub Jan. 4, 2005.

(56) References Cited

OTHER PUBLICATIONS

Slaymaker et al., Rationally engineered Cas9 nucleases with improved specificity. Science. Jan. 1, 2016;351(6268):84-8. doi: 10.1126/science.aad5227. Epub Dec. 1, 2015.
Sledz et al., Structural insights into the molecular mechanism of the m(6)A writer complex. Elife. Sep. 14, 2016;5:e18434. doi: 10.7554/eLife.18434.
Smargon et al., Cas13b Is a Type VI-B CRISPR-Associated RNA-Guided RNase Differentially Regulated by Accessory Proteins Csx27 and Csx28. Mol Cell. Feb. 16, 2017;65(4):618-630.e7. doi: 10.1016/j.molcel.2016.12.023. Epub Jan. 5, 2017.
Smith et al., Expression of a dominant negative retinoic acid receptor γ in Xenopus embryos leads to partial resistance to retinoic acid. Roux Arch Dev Biol. Mar. 1994;203(5):254-265. doi: 10.1007/BF00360521.
Smith et al., Production of human beta interferon in insect cells infected with a baculovirus expression vector. Mol Cell Biol. Dec. 1983;3(12):2156-65. doi: 10.1128/mcb.3.12.2156.
Smith, Filamentous fusion phage: novel expression vectors that display cloned antigens on the virion surface. Science. Jun. 14, 1985;228(4705):1315-7.
Smith, Phage-encoded Serine Integrases and Other Large Serine Recombinases. Microbiol Spectr. Aug. 2015;3(4). doi: 10.1128/microbiolspec.MDNA3-0059-2014.
Southworth et al., Control of protein splicing by intein fragment reassembly. EMBO J. Feb. 16, 1998;17(4):918-26. doi: 10.1093/emboj/17.4.918.
Southworth et al., Purification of proteins fused to either the amino or carboxy terminus of the *Mycobacterium xenopi* gyrase A intein. Biotechniques. Jul. 1999;27(1):110-4, 116, 118-20. doi: 10.2144/99271st04.
Spencer et al., A general strategy for producing conditional alleles of Src-like tyrosine kinases. Proc Natl Acad Sci U S A. Oct. 10, 1995;92(21):9805-9. doi: 10.1073/pnas.92.21.9805.
Spencer et al., Functional analysis of Fas signaling in vivo using synthetic inducers of dimerization. Curr Biol. Jul. 1, 1996;6(7):839-47. doi: 10.1016/s0960-9822(02)00607-3.
Srivastava et al., An inhibitor of nonhomologous end-joining abrogates double-strand break repair and impedes cancer progression. Cell. Dec. 21, 2012;151(7):1474-87. doi: 10.1016/j.cell.2012.11.054.
Stamos et al., Structure of a Thermostable Group II Intron Reverse Transcriptase with Template-Primer and Its Functional and Evolutionary Implications. Mol Cell. Dec. 7, 2017;68(5):926-939.e4. doi: 10.1016/j.molcel.2017.10.024. Epub Nov. 16, 2017.
Steele et al., The prion protein knockout mouse: a phenotype under challenge. Prion. Apr.-Jun. 2007;1(2):83-93. doi: 10.4161/pri.1.2.4346. Epub Apr. 25, 2007.
Stenglein et al., APOBEC3 proteins mediate the clearance of foreign DNA from human cells. Nat Struct Mol Biol. Feb. 2010;17(2):222-9. doi: 10.1038/nsmb.1744. Epub Jan. 10, 2010.
Stephens et al., The landscape of cancer genes and mutational processes in breast cancer. Nature Jun. 2012;486:400-404. doi:10.1038/nature11017.
Sternberg et al., DNA interrogation by the CRISPR RNA-guided endonuclease Cas9. Nature.Mar. 6, 2014;507(7490):62-7. doi: 10.1038/nature13011. Epub Jan. 29, 2014.
Sterne-Weiler et al., Exon identity crisis: disease-causing mutations that disrupt the splicing code. Genome Biol. Jan. 23, 2014;15(1):201. doi: 10.1186/gb4150.
Stevens et al., Design of a Split Intein with Exceptional Protein-Splicing Activity. J Am Chem Soc. Feb. 24, 2016;138(7):2162-5. doi: 10.1021/jacs.5b13528. Epub Feb. 8, 2016.
Stevens et al., A promiscuous split intein with expanded protein engineering applications. Proc Natl Acad Sci U S A. Aug. 8, 2017;114(32):8538-8543. doi: 10.1073/pnas.1701083114. Epub Jul. 24, 2017.
Stockwell et al., Probing the role of homomeric and heteromeric receptor interactions in TGF-beta signaling using small molecule dimerizers. Curr Biol. Jun. 18, 1998;8(13):761-70. doi: 10.1016/s0960-9822(98)70299-4.
Strutt et al., RNA-dependent RNA targeting by CRISPR-Cas9. Elife. Jan. 5, 2018;7:e32724. doi: 10.7554/eLife.32724.
Su et al., Human DNA polymerase ? has reverse transcriptase activity in cellular environments. J Biol Chem. Apr. 12, 2019;294(15):6073-6081. doi: 10.1074/jbc.RA119.007925. Epub Mar. 6, 2019.
Sudarsan et al., An mRNA structure in bacteria that controls gene expression by binding lysine. Genes Dev. Nov. 1, 2003;17(21):2688-97.
Suess et al., A theophylline responsive riboswitch based on helix slipping controls gene expression in vivo. Nucleic Acids Res. Mar. 5, 2004;32(4):1610-4.
Sun et al., Optimized TAL effector nucleases (TALENs) for use in treatment of sickle cell disease. Mol Biosyst. Apr. 2012;8(4):1255-63. doi: 10.1039/c2mb05461b. Epub Feb. 3, 2012.
Sun et al., The CRISPR/Cas9 system for gene editing and its potential application in pain research. Transl Periop & Pain Med. Aug. 3, 2016;1(3):22-33.
Surun et al., High Efficiency Gene Correction in Hematopoietic Cells by Donor-Template-Free CRISPR/Cas9 Genome Editing. Mol Ther Nucleic Acids. Mar. 2, 2018;10:1-8. doi: 10.1016/j.omtn.2017.11.001. Epub Nov. 10, 2017.
Suzuki et al., In vivo genome editing via CRISPR/Cas9 mediated homology-independent targeted integration. Nature. Dec. 1, 2016;540(7631):144-149. doi: 10.1038/nature20565. Epub Nov. 16, 2016.
Suzuki et al., VCre/VloxP and SCre/SloxP: new site-specific recombination systems for genome engineering. Nucleic Acids Res. Apr. 2011;39(8):e49. doi: 10.1093/nar/gkq1280. Epub Feb. 1, 2011.
Swarts et al., Argonaute of the archaeon Pyrococcus furiosus is a DNA-guided nuclease that targets cognate DNA. Nucleic Acids Res. May 26, 2015;43(10):5120-9. doi: 10.1093/nar/gkv415. Epub Apr. 29, 2015.
Swarts et al., DNA-guided DNA interference by a prokaryotic Argonaute. Nature. Mar. 13, 2014;507(7491):258-61. doi: 10.1038/nature12971. Epub Feb. 16, 2014.
Swarts et al., The evolutionary journey of Argonaute proteins. Nat Struct Mol Biol. Sep. 2014;21(9):743-53. doi: 10.1038/nsmb.2879.
Szczepek et al., Structure-based redesign of the dimerization interface reduces the toxicity of zinc-finger nucleases. Nat Biotechnol. Jul. 2007;25(7):786-93. Epub Jul. 1, 2007.
Tabebordbar et al., In vivo gene editing in dystrophic mouse muscle and muscle stem cells. Science. Jan. 22, 2016;351(6271):407-411. doi: 10.1126/science.aad5177. Epub Dec. 31, 2015.
Tagalakis et al., Lack of RNA-DNA oligonucleotide (chimeraplast) mutagenic activity in mouse embryos. Mol Reprod Dev. Jun. 2005;71(2):140-4.
Tahara et al., Potent and Selective Inhibitors of 8-Oxoguanine DNA Glycosylase. J Am Chem Soc. Feb. 14, 2018;140(6):2105-2114. doi: 10.1021/jacs.7b09316. Epub Feb. 5, 2018.
Tajiri et al., Functional cooperation of MutT, MutM and MutY proteins in preventing mutations caused by spontaneous oxidation of guanine nucleotide in *Escherichia coli*. Mutat Res. May 1995;336(3):257-67. doi: 10.1016/0921-8777(94)00062-b.
Tambunan et al., Vaccine Design for H5N1 Based on B- and T-cell Epitope Predictions. Bioinform Biol Insights. Apr. 28, 2016;10:27-35. doi: 10.4137/BBI.S38378.
Tanenbaum et al., A protein-tagging system for signal amplification in gene expression and fluorescence imaging. Cell. Oct. 23, 2014;159(3):635-46. doi: 10.1016/j.cell.2014.09.039. Epub Oct. 9, 2014.
Tang et al., Aptazyme-embedded guide RNAs enable ligand-responsive genome editing and transcriptional activation. Nat Commun. Jun. 28, 2017;8:15939. doi: 10.1038/ncomms15939.
Tang et al., Evaluation of Bioinformatic Programmes for the Analysis of Variants within Splice Site Consensus Regions. Adv Bioinformatics. 2016;2016:5614058. doi: 10.1155/2016/5614058. Epub May 24, 2016.

(56) References Cited

OTHER PUBLICATIONS

Tang et al., Rewritable multi-event analog recording in bacterial and mammalian cells. Science. Apr. 13, 2018;360(6385):eaap8992. doi: 10.1126/science.aap8992. Epub Feb. 15, 2018.
Tassabehji, Williams-Beuren syndrome: a challenge for genotype-phenotype correlations. Hum Mol Genet. Oct. 15, 2003;12 Spec No. 2:R229-37. doi: 10.1093/hmg/ddg299. Epub Sep. 2, 2003.
Taube et al., Reverse transcriptase of mouse mammary tumour virus: expression in bacteria, purification and biochemical characterization. Biochem J. Feb. 1, 1998;329 ( Pt 3)(Pt 3):579-87. doi: 10.1042/bj3290579. Erratum in: Biochem J Jun. 15, 1998;332(Pt 3):808.
Tebas et al., Gene editing of CCR5 in autologous CD4 T cells of persons infected with HIV. N Engl J Med. Mar. 6, 2014;370(10):901-10. doi: 10.1056/NEJMoa1300662.
Tee et al., Polishing the craft of genetic diversity creation in directed evolution. Biotechnol Adv. Dec. 2013;31(8):1707-21. doi: 10.1016/j.biotechadv.2013.08.021. Epub Sep. 6, 2013.
Telenti et al., The *Mycobacterium xenopi* GyrA protein splicing element: characterization of a minimal intein. J Bacteriol. Oct. 1997;179(20):6378-82. doi: 10.1128/jb.179.20.6378-6382.1997.
Telesnitsky et al., RNase H domain mutations affect the interaction between Moloney murine leukemia virus reverse transcriptase and its primer-template. Proc Natl Acad Sci U S A. Feb. 15, 1993;90(4):1276-80. doi: 10.1073/pnas.90.4.1276.
Tessarollo et al., Targeted mutation in the neurotrophin-3 gene results in loss of muscle sensory neurons. Proc Natl Acad Sci U S A. Dec. 6, 1994;91(25):11844-8.
Tesson et al., Knockout rats generated by embryo microinjection of TALENs. Nat Biotechnol. Aug. 5, 2011;29(8):695-6. doi: 10.1038/nbt.1940.
Thompson et al., Cellular uptake mechanisms and endosomal trafficking of supercharged proteins. Chem Biol. Jul. 27, 2012;19(7):831-43. doi: 10.1016/j.chembiol.2012.06.014.
Thompson et al., Engineering and identifying supercharged proteins for macromolecule delivery into mammalian cells. Methods Enzymol. 2012;503:293-319. doi: 10.1016/B978-0-12396962-0.00012-4.
Thorpe et al., Functional correction of episomal mutations with short DNA fragments and RNA-DNA oligonucleotides. J Gene Med. Mar.-Apr. 2002;4(2):195-204.
Thuronyi et al., Continuous evolution of base editors with expanded target compatibility and improved activity. Nat Biotechnol. Sep. 2019;37(9):1070-1079. doi: 10.1038/s41587-019-0193-0. Epub Jul. 22, 2019.
Thyagarajan et al., Creation of engineered human embryonic stem cell lines using phiC31 integrase. Stem Cells. Jan. 2008;26(1):119-26. doi: 10.1634/stemcells.2007-0283. Epub Oct. 25, 2007.
Thyagarajan et al., Mammalian genomes contain active recombinase recognition sites. Gene. Feb. 22, 2000;244(1-2):47-54.
Thyagarajan et al., Site-specific genomic integration in mammalian cells mediated by phage phiC31 integrase. Mol Cell Biol. Jun. 2001;21(12):3926-34.
Tinland et al., The T-DNA-linked VirD2 protein contains two distinct functional nuclear localization signals. Proc Natl Acad Sci U S A. Aug. 15, 1992;89(16):7442-6. doi: 10.1073/pnas.89.16.7442.
Tirumalai et al., Recognition of core-type DNA sites by lambda integrase. J Mol Biol. Jun. 12, 1998;279(3):513-27.
Tom et al., Mechanism whereby proliferating cell nuclear antigen stimulates flap endonuclease 1. J Biol Chem. Apr. 7, 2000;275(14):10498-505. doi: 10.1074/jbc.275.14.10498.
Toor et al., Crystal structure of a self-spliced group II intron. Science. Apr. 4, 2008;320(5872):77-82. doi: 10.1126/science.1153803.
Torres et al., Non-integrative lentivirus drives high-frequency cre-mediated cassette exchange in human cells. PLoS One. 2011;6(5):e19794. doi: 10.1371/journal.pone.0019794. Epub May 23, 2011.
Tourdot et al., A general strategy to enhance immunogenicity of low-affinity HLA-A2. 1-associated peptides: implication in the identification of cryptic tumor epitopes. Eur J Immunol. Dec. 2000;30(12):3411-21.
Townsend et al., Role of HFE in iron metabolism, hereditary haemochromatosis, anaemia of chronic disease, and secondary iron overload. Lancet. Mar. 2, 2002;359(9308):786-90. doi: 10.1016/S0140-6736(02)07885-6. Erratum in: Lancet Jul. 13, 2002;360(9327):176.
Tracewell et al., Directed enzyme evolution: climbing fitness peaks one amino acid at a time. Curr Opin Chem Biol. Feb. 2009;13(1):3-9. doi: 10.1016/j.cbpa.2009.01.017. Epub Feb. 25, 2009.
Tratschin et al., A human parvovirus, adeno-associated virus, as a eucaryotic vector: transient expression and encapsidation of the procaryotic gene for chloramphenicol acetyltransferase. Mol Cell Biol. Oct. 1984;4(10):2072-81. doi: 10.1128/mcb.4.10.2072.
Tratschin et al., Adeno-associated virus vector for high-frequency integration, expression, and rescue of genes in mammalian cells. Mol Cell Biol. Nov. 1985;5(11):3251-60. doi: 10.1128/mcb.5.11.3251.
Trausch et al., The structure of a tetrahydrofolate-sensing riboswitch reveals two ligand binding sites in a single aptamer. Structure. Oct. 12, 2011;19(10):1413-23. doi: 10.1016/j.str.2011.06.019. Epub Sep. 8, 2011.
Traxler et al., A genome-editing strategy to treat ?-hemoglobinopathies that recapitulates a mutation associated with a benign genetic condition. Nat Med. Sep. 2016;22(9):987-90. doi: 10.1038/nm.4170. Epub Aug. 15, 2016.
Trudeau et al., On the Potential Origins of the High Stability of Reconstructed Ancestral Proteins. Mol Biol Evol. Oct. 2016;33(10):2633-41. doi: 10.1093/molbev/msw138. Epub Jul. 12, 2016.
Truong et al., Development of an intein-mediated split-Cas9 system for gene therapy. Nucleic Acids Res. Jul. 27, 2015;43(13):6450-8. doi: 10.1093/nar/gkv601. Epub Jun. 16, 2015. With Supplementary Data.
Tsai et al., CIRCLE-seq: a highly sensitive in vitro screen for genome-wide CRISPR-Cas9 nuclease off-targets. Nat Methods. Jun. 2017;14(6):607-614. doi: 10.1038/nmeth.4278. Epub May 1, 2017.
Tsai et al., Dimeric CRISPR RNA-guided FokI nucleases for highly specific genome editing. Nat Biotechnol. Jun. 2014;32(6):569-76. doi: 10.1038/nbt.2908. Epub Apr. 25, 2014.
Tsai et al., GUIDE-seq enables genome-wide profiling of off-target cleavage by CRISPR-Cas nucleases. Nat Biotechnol. Feb. 2015;33(2):187-97. doi: 10.1038/nbt.3117. Epub Dec. 16, 2014.
Tsang et al., Specialization of the DNA-cleaving activity of a group I ribozyme through in vitro evolution. J Mol Biol. Sep. 13, 1996;262(1):31-42. doi: 10.1006/jmbi.1996.0496.
Tsutakawa et al., Human flap endonuclease structures, DNA double-base flipping, and a unified understanding of the FEN1 superfamily. Cell. Apr. 15, 2011;145(2):198-211. doi: 10.1016/j.cell.2011.03.004.
Turan et al., Recombinase-mediated cassette exchange (RMCE)—a rapidly-expanding toolbox for targeted genomic modifications. Gene. Feb. 15, 2013;515(1):1-27. doi: 10.1016/j.gene.2012.11.016. Epub Nov. 29, 2012.
Turan et al., Recombinase-mediated cassette exchange (RMCE): traditional concepts and current challenges. J Mol Biol. Mar. 25, 2011;407(2):193-221. doi: 10.1016/j.jmb.2011.01.004. Epub Jan. 15, 2011.
Turan et al., Site-specific recombinases: from tag-and-target- to tag-and-exchange-based genomic modifications. FASEB J. Dec. 2011;25(12):4088-107. doi: 10.1096/fj.11-186940. Epub Sep. 2, 2011. Review.
Tycko et al., Pairwise library screen systematically interrogates *Staphylococcus aureus* Cas9 specificity in human cells. bioRxiv. doi: https://doi.org/10.1101/269399 Posted Feb. 22, 2018.
UNIPROT Submission; UniProt, Accession No. P01011. Last modified Jun. 11, 2014, version 2. 15 pages.
UNIPROT Submission; UniProt, Accession No. P01011. Last modified Sep. 18, 2013, version 2. 15 pages.

(56) References Cited

OTHER PUBLICATIONS

UNIPROT Submission; UniProt, Accession No. P04264. Last modified Jun. 11, 2014, version 6. 15 pages.
UNIPROT Submission; UniProt, Accession No. P04275. Last modified Jul. 9, 2014, version 107. 29 pages.
UNIPROTKB Submission; Accession No. F0NH53. May 3, 2011. 4 pages.
UNIPROTKB Submission; Accession No. F0NN87. May 3, 2011. 4 pages.
UNIPROTKB Submission; Accession No. G3ECR1.2. No Author Listed., Aug. 12, 2020, 8 pages.
UNIPROTKB Submission; Accession No. P04264. No Author Listed., Apr. 7, 2021. 12 pages.
UNIPROTKB Submission; Accession No. T0D7A2. Oct. 16, 2013. 10 pages.
UNIPROTKB Submission; Accession No. U2UMQ6. No Author Listed., Apr. 7, 2021, 11 pages.
Urasaki et al., Functional dissection of the Tol2 transposable element identified the minimal cis-sequence and a highly repetitive sequence in the subterminal region essential for transposition. Genetics. Oct. 2006;174(2):639-49. doi: 10.1534/genetics.106.060244. Epub Sep. 7, 2006.
Urnov et al., Genome editing with engineered zinc finger nucleases. Nat Rev Genet. Sep. 2010;11(9):636-46. doi: 10.1038/nrg2842.
Urnov et al., Highly efficient endogenous human gene correction using designed zinc-finger nucleases. Nature. Jun. 2, 2005;435(7042):646-51. Epub Apr. 3, 2005.
Vagner et al., Efficiency of homologous DNA recombination varies along the Bacillus subtilis chromosome. J Bacteriol. Sep. 1988;170(9):3978-82.
Van Brunt et al., Molecular Farming: Transgenic Animals as Bioreactors. Biotechnology (NY). 1988;6(10):1149-1154. doi: 10.1038/nbt1088-1149.
Van Duyne et al., Teaching Cre to follow directions. Proc Natl Acad Sci U S A. Jan. 6, 2009;106(1):4-5. doi: 10.1073/pnas.0811624106. Epub Dec. 31, 2008.
Van Overbeek et al., DNA Repair Profiling Reveals Nonrandom Outcomes at Cas9-Mediated Breaks. Mol Cell. Aug. 18, 2016;63(4):633-646. doi: 10.1016/j.molcel.2016.06.037. Epub Aug. 4, 2016.
Van Swieten et al., A mutation in the fibroblast growth factor 14 gene is associated with autosomal dominant cerebellar ataxia [corrected]. Am J Hum Genet. Jan. 2003;72(1):191-9. Epub Dec. 13, 2002.
Vanamee et al., FokI requires two specific DNA sites for cleavage. J Mol Biol. May 25, 2001;309(1):69-78.
Vik et al., Endonuclease V cleaves at inosines in RNA. Nat Commun. 2013;4:2271. doi: 10.1038/ncomms3271.
Vitreschak et al., Regulation of the vitamin B12 metabolism and transport in bacteria by a conserved RNA structural element. RNA. Sep. 2003;9(9):1084-97.
Voigt et al., Rational evolutionary design: the theory of in vitro protein evolution. Adv Protein Chem. 2000;55:79-160.
Wacey et al., Disentangling the perturbational effects of amino acid substitutions in the DNA-binding domain of p53. Hum Genet. Jan. 1999;104(1):15-22.
Wadia et al., Modulation of cellular function by TAT mediated transduction of full length proteins. Curr Protein Pept Sci. Apr. 2003;4(2):97-104.
Wadia et al., Transducible TAT-HA fusogenic peptide enhances escape of TAT-fusion proteins after lipid raft macropinocytosis. Nat Med. Mar. 2004;10(3):310-5. Epub Feb. 8, 2004.
Wah et al., Structure of FokI has implications for DNA cleavage. Proc Natl Acad Sci U S A. Sep. 1, 1998;95(18):10564-9.
Wals et al., Unnatural amino acid incorporation in E. coli: current and future applications in the design of therapeutic proteins. Front Chem. Apr. 1, 2014;2:15. doi: 10.3389/fchem.2014.00015. eCollection 2014.
Wang et al. CRISPR-Cas9 and CRISPR-Assisted Cytidine Deaminase Enable Precise and Efficient Genome Editing in Klebsiella pneumoniae. Appl Environ Microbiol. 2018;84(23):e01834-18. Published Nov. 15, 2018. doi:10.1128/AEM.01834-18.
Wang et al., AID upmutants isolated using a high-throughput screen highlight the immunity/cancer balance limiting DNA deaminase activity. Nat Struct Mol Biol. Jul. 2009;16(7):769-76. doi: 10.1038/nsmb.1623. Epub Jun. 21, 2009.
Wang et al., Continuous directed evolutions of proteins with improved soluble expression. Nature Chemical Biology. Nat Publishing Group. Aug. 20, 2018; 14(10):972-980.
Wang et al., CRISPR-Cas9 Targeting of PCSK9 in Human Hepatocytes In Vivo—Brief Report. Arterioscler Thromb Vasc Biol. May 2016;36(5):783-6. doi: 10.1161/ATVBAHA.116.307227. Epub Mar. 3, 2016.
Wang et al., Efficient delivery of genome-editing proteins using bioreducible lipid nanoparticles. Proc Natl Acad Sci U S A. Feb. 29, 2016. pii: 201520244. [Epub ahead of print].
Wang et al., Enhanced base editing by co-expression of free uracil DNA glycosylase inhibitor. Cell Res. Oct. 2017;27(1):1289-92. doi: 10.1038/cr.2017.111. Epub Aug. 29, 2017.
Wang et al., Evolution of new nonantibody proteins via iterative somatic hypermutation. Proc Natl Acad Sci U S A. Nov. 30, 2004;101(48):16745-9. Epub Nov. 19, 2004.
Wang et al., Genetic screens in human cells using the CRISPR-Cas9 system. Science. Jan. 3, 2014;343(6166):80-4. doi: 10.1126/science.1246981. Epub Dec. 12, 2013.
Wang et al., N(6)-methyladenosine Modulates Messenger RNA Translation Efficiency. Cell. Jun. 4, 2015;161(6):1388-99. doi: 10.1016/j.cell.2015.05.014.
Wang et al., N6-methyladenosine-dependent regulation of messenger RNA stability. Nature. Jan. 2, 2014;505(7481):117-20. doi: 10.1038/nature12730. Epub Nov. 27, 2013.
Wang et al., Nucleation, propagation and cleavage of target RNAs in Ago silencing complexes. Nature. Oct. 8, 2009;461(7265):754-61. doi: 10.1038/nature08434.
Wang et al., One-step generation of mice carrying mutations in multiple genes by CRISPR/Cas-mediated genome engineering. Cell. May 9, 2013;153(4):910-8. doi: 10.1016/j.cell.2013.04.025. Epub May 2, 2013.
Wang et al., Programming cells by multiplex genome engineering and accelerated evolution. Nature. Aug. 13, 2009;460(7257):894-8. Epub Jul. 26, 2009.
Wang et al., Reading RNA methylation codes through methyl-specific binding proteins. RNA Biol. 2014;11(6):669-72. doi: 10.4161/rna.28829. Epub Apr. 24, 2014.
Wang et al., Recombinase technology: applications and possibilities. Plant Cell Rep. Mar. 2011;30(3):267-85. doi: 10.1007/s00299-010-0938-1. Epub Oct. 24, 2010.
Wang et al., Riboswitches that sense S-adenosylhomocysteine and activate genes involved in coenzyme recycling. Mol Cell. Mar. 28, 2008;29(6):691-702. doi: 10.1016/j.molcel.2008.01.012.
Wang et al., Targeted gene addition to a predetermined site in the human genome using a ZFN-based nicking enzyme. Genome Res. Jul. 2012;22(7):1316-26. doi: 10.1101/gr.122879.111. Epub Mar. 20, 2012.
Wang et al., Uracil-DNA glycosylase inhibitor gene of bacteriophage PBS2 encodes a binding protein specific for uracil-DNA glycosylase. J Biol Chem. Jan. 15, 1989;264(2):1163-71.
Warren et al., A chimeric Cre recombinase with regulated directionality. Proc Natl Acad Sci U S A. Nov. 25, 2008;105(47):18278-83. doi: 10.1073/pnas.0809949105. Epub Nov. 14, 2008.
Warren et al., Mutations in the amino-terminal domain of lambda-integrase have differential effects on integrative and excisive recombination. Mol Microbiol. Feb. 2005;55(4):1104-12.
Watowich, The erythropoietin receptor: molecular structure and hematopoietic signaling pathways. J Investig Med. Oct. 2011;59(7):1067-72. doi: 10.2310/JIM.0b013e31820fb28c.
Weber et al., Assembly of designer TAL effectors by Golden Gate cloning. PLoS One. 2011;6(5):e19722. doi:10.1371/journal.pone.0019722. Epub May 19, 2011.
Weinberg et al., New Classes of Self-Cleaving Ribozymes Revealed by Comparative Genomics Analysis. Nat Chem Biol. Aug. 2015;11(8):606-10. doi: 10.1038/nchembio.1846. Epub Jul. 13, 2015.

(56) References Cited

OTHER PUBLICATIONS

Weinberg et al., The aptamer core of SAM-IV riboswitches mimics the ligand-binding site of SAM-I riboswitches. RNA. May 2008;14(5):822-8. doi: 10.1261/rna.988608. Epub Mar. 27, 2008.
Weinberger et al., Disease-causing mutations C277R and C277Y modify gating of human ClC-1 chloride channels in myotonia congenita. J Physiol. Aug. 1, 2012;590(Pt 15):3449-64. doi: 0.1113/jphysiol.2012.232785. Epub May 28, 2012.
Wen et al., Inclusion of a universal tetanus toxoid CD4(+) T cell epitope P2 significantly enhanced the immunogenicity of recombinant rotavirus ?VP8* subunit parenteral vaccines. Vaccine. Jul. 31, 2014;32(35):4420-4427. doi: 10.1016/j.vaccine.2014.06.060. Epub Jun. 21, 2014.
Wharton et al., A new-specificity mutant of 434 repressor that defines an amino acid-base pair contact. Nature. Apr. 30-May 6, 1987;326(6116):888-91.
Wharton et al., Changing the binding specificity of a repressor by redesigning an alpha-helix. Nature. Aug. 15-21, 1985;316(6029):601-5.
Wheeler et al., The thermostability and specificity of ancient proteins. Curr Opin Struct Biol. Jun. 2016;38:37-43. doi: 10.1016/j.sbi.2016.05.015. Epub Jun. 9, 2016.
Wiedenheft et al., RNA-guided genetic silencing systems in bacteria and archaea. Nature. Feb. 15, 2012;482(7385):331-8. doi: 10.1038/nature10886. Review.
Wienert et al., KLF1 drives the expression of fetal hemoglobin in British HPFH. Blood. Aug. 10, 2017;130(6):803-807. doi: 10.1182/blood-2017-02-767400. Epub Jun. 28, 2017.
Wijesinghe et al., Efficient deamination of 5-methylcytosines in DNA by human APOBEC3A, but not by AID or APOBEC3G. Nucleic Acids Res. Oct. 2012;40(18):9206-17. doi: 10.1093/nar/gks685. Epub Jul. 13, 2012.
Wijnker et al., Managing meiotic recombination in plant breeding. Trends Plant Sci. Dec. 2008;13(12):640-6. doi: 10.1016/j.tplants.2008.09.004. Epub Oct. 22, 2008.
Williams et al., Assessing the accuracy of ancestral protein reconstruction methods. PLoS Comput Biol. Jun. 23, 2006;2(6):e69. doi: 10.1371/journal.pcbi.0020069. Epub Jun. 23, 2006.
Wilson et al., Assessing annotation transfer for genomics: quantifying the relations between protein sequence, structure and function through traditional and probabilistic scores. J Mol Biol 2000;297:233-49.
Wilson et al., Formation of infectious hybrid virions with gibbon ape leukemia virus and human T-cell leukemia virus retroviral envelope glycoproteins and the gag and pol proteins of Moloney murine leukemia virus. J Virol. May 1989;63(5):2374-8. doi: 10.1128/JVI.63.5.2374-2378.1989.
Wilson et al., In Vitro Selection of Functional Nucleic Acids. Annu Rev Biochem. 1999;68:611-47. doi: 10.1146/annurev.biochem.68.1.611.
Wilson et al., Kinase dynamics. Using ancient protein kinases to unravel a modern cancer drug's mechanism. Science. Feb. 20, 2015;347(6224):882-6. doi: 10.1126/science.aaa1823.
Winkler et al., An mRNA structure that controls gene expression by binding FMN. Proc Natl Acad Sci U S A. Dec. 10, 2002;99(25):15908-13. Epub Nov. 27, 2002.
Winkler et al., Control of gene expression by a natural metabolite-responsive ribozyme. Nature. Mar. 18, 2004;428(6980):281-6.
Winkler et al., Thiamine derivatives bind messenger RNAs directly to regulate bacterial gene expression. Nature. Oct. 31, 2002;419(6910):952-6. Epub Oct. 16, 2002.
Winoto et al., A novel, inducible and T cell-specific enhancer located at the 3' end of the T cell receptor alpha locus. EMBO J. Mar. 1989;8(3):729-33.
Wolf et al., tadA, an essential tRNA-specific adenosine deaminase from *Escherichia coli*. EMBO J. Jul. 15, 2002;21(14):3841-51.
Wolfe et al., Analysis of zinc fingers optimized via phage display: evaluating the utility of a recognition code. J Mol Biol. Feb. 5, 1999;285(5):1917-34.
Wong et al., A statistical analysis of random mutagenesis methods used for directed protein evolution. J Mol Biol. Jan. 27, 2006;355(4):858-71. Epub Nov. 17, 2005.
Wong et al., The Diversity Challenge in Directed Protein Evolution. Comb Chem High Throughput Screen. May 2006;9(4):271-88.
Wood et al., Targeted genome editing across species using ZFNs and TALENs. Science. Jul. 15, 2011;333(6040):307. doi: 10.1126/science.1207773. Epub Jun. 23, 2011.
Wright et al., Continuous in vitro evolution of catalytic function. Science. Apr. 25, 1997;276(5312):614-7.
Wright et al., Rational design of a split-Cas9 enzyme complex. Proc Natl Acad Sci U S A. Mar. 10, 2015;112(10):2984-9. doi: 10.1073/pnas.1501698112. Epub Feb. 23, 2015.
Wu et al., Correction of a genetic disease in mouse via use of CRISPR-Cas9. Cell Stem Cell. Dec. 5, 2013;13(6):659-62. doi: 10.1016/j.stem.2013.10.016.
Wu et al., Genome-wide binding of the CRISPR endonuclease Cas9 in mammalian cells. Nat Biotechnol. Jul. 2014;32(7):670-6. doi: 10.1038/nbt.2889. Epub Apr. 20, 2014.
Wu et al., Protein trans-splicing by a split intein encoded in a split DnaE gene of *Synechocystis* sp. PCC6803. Proc Natl Acad Sci U S A. Aug. 4, 1998;95(16):9226-31. doi: 10.1073/pnas.95.16.9226.
Xiang et al., RNA m6A methylation regulates the ultraviolet-induced DNA damage response. Nature. Mar. 23, 2017;543(7646):573-576. doi: 10.1038/nature21671. Epub Mar. 15, 2017.
Xiao et al., Nuclear m(6)A Reader YTHDC1 Regulates mRNA Splicing. Mol Cell. Feb. 18, 2016;61(4):507-519. doi: 10.1016/j.molcel.2016.01.012. Epub Feb. 11, 2016.
Xiong et al., Origin and evolution of retroelements based upon their reverse transcriptase sequences. EMBO J. Oct. 1990;9(10):3353-62.
Xu et al., Chemical ligation of folded recombinant proteins: segmental isotopic labeling of domains for NMR studies. Proc Natl Acad Sci U S A. Jan. 19, 1999;96(2):388-93. doi: 10.1073/pnas.96.2.388.
Xu et al., Accuracy and efficiency define Bxb1 integrase as the best of fifteen candidate serine recombinases for the integration of DNA into the human genome. BMC Biotechnol. Oct. 20, 2013;13:87. doi: 10.1186/1472-6750-13-87.
Xu et al., Protein splicing: an analysis of the branched intermediate and its resolution by succinimide formation. EMBO J. Dec. 1, 1994;13(23):5517-22.
Xu et al., Sequence determinants of improved CRISPR sgRNA design. Genome Res. Aug. 2015;25(8):1147-57. doi: 10.1101/gr.191452.115. Epub Jun. 10, 2015.
Xu et al., Structures of human ALKBH5 demethylase reveal a unique binding mode for specific single-stranded N6-methyladenosine RNA demethylation. J Biol Chem. Jun. 20, 2014;289(25):17299-311. doi: 10.1074/jbc.M114.550350. Epub Apr. 28, 2014.
Xu et al., The mechanism of protein splicing and its modulation by mutation. EMBO J. Oct. 1, 1996;15(19):5146-53.
Yahata et al., Unified, Efficient, and Scalable Synthesis of Halichondrins: Zirconium/Nickel-Mediated One-Pot Ketone Synthesis as the Final Coupling Reaction. Angew Chem Int Ed Engl. Aug. 28, 2017;56(36):10796-10800. doi: 10.1002/anie.201705523. Epub Jul. 28, 2017.
Yamamoto et al., The ons and offs of inducible transgenic technology: a review. Neurobiol Dis. Dec. 2001;8(6):923-32.
Yamamoto et al., Virological and immunological bases for HIV-1 vaccine design. Uirusu 2007;57(2):133-139. https://doi.org/10.2222/jsv.57.133.
Yamano et al., Crystal Structure of Cpf1 in Complex with Guide RNA and Target DNA. Cell May 2016;165(4)949-62.
Yan et al., Cas13d Is a Compact RNA-Targeting Type VI CRISPR Effector Positively Modulated by a WYL-Domain-Containing Accessory Protein. Mol Cell. Apr. 19, 2018;70(2):327-339.e5. doi: 10.1016/j.molcel.2018.02.028. Epub Mar. 15, 2018.
Yang et al., APOBEC: From mutator to editor. J Genet Genomics. Sep. 20, 2017;44(9):423-437. doi: 10.1016/j.jgg.2017.04.009. Epub Aug. 7, 2017.
Yang et al., Construction of an integration-proficient vector based on the site-specific recombination mechanism of enterococcal temperate phage phiFC1. J Bacteriol. Apr. 2002;184(7):1859-64. doi: 10.1128/jb.184.7.1859-1864.2002.

(56) References Cited

OTHER PUBLICATIONS

Yang et al., Engineering and optimising deaminase fusions for genome editing. Nat Commun. Nov. 2, 2016;7:13330. doi: 10.1038/ncomms13330.

Yang et al., Genome editing with targeted deaminases. BioRxiv. Preprint. First posted online Jul. 28, 2016.

Yang et al., New CRISPR-Cas systems discovered. Cell Res. Mar. 2017;27(3):313-314. doi: 10.1038/cr.2017.21. Epub Feb. 21, 2017.

Yang et al., One-step generation of mice carrying reporter and conditional alleles by CRISPR/Cas-mediated genome engineering. Cell. Sep. 12, 2013;154(6):1370-9. doi: 10.1016/j.cell.2013.08.022. Epub Aug. 29, 2013.

Yang et al., PAM-dependent Target DNA Recognition and Cleavage by C2C1 CRISPR-Cas endonuclease. Cell Dec. 2016;167(7):1814-28.

Yang et al., Permanent genetic memory with >1-byte capacity. Nat Methods. Dec. 2014;11(12):1261-6. doi: 10.1038/nmeth.3147. Epub Oct. 26, 2014.

Yang et al., Small-molecule control of insulin and PDGF receptor signaling and the role of membrane attachment. Curr Biol. Jan. 1, 1998;8(1):11-8. doi: 10.1016/s0960-9822(98)70015-6.

Yang, PAML 4: phylogenetic analysis by maximum likelihood. Mol Biol Evol. Aug. 2007;24(8):1586-91. doi: 10.1093/molbev/msm088. Epub May 4, 2007.

Yang, Phylogenetic Analysis by Maximum Likelihood (PAML). //abacus.gene.ucl.ac.uk/software/paml.html Last accessed Apr. 28, 2021.

Yanover et al., Extensive protein and DNA backbone sampling improves structure-based specificity prediction for C2H2 zinc fingers. Nucleic Acids Res. Jun. 2011;39(11):4564-76. doi: 10.1093/nar/gkr048. Epub Feb. 22, 2011.

Yasui et al., Miscoding Properties of 2'-Deoxyinosine, a Nitric Oxide-Derived DNA Adduct, during Translesion Synthesis Catalyzed by Human DNA Polymerases. J Molec Biol. Apr. 4, 2008;377(4):1015-23.

Yasukawa et al., Characterization of Moloney murine leukaemia virus/avian myeloblastosis virus chimeric reverse transcriptases. J Biochem. Mar. 2009;145(3):315-24. doi: 10.1093/jb/mvn166. Epub Dec. 6, 2008.

Yazaki et al., Hereditary systemic amyloidosis associated with a new apolipoprotein AII stop codon mutation Stop78Arg. Kidney Int. Jul. 2003;64(1):11-6.

Yin et al., Genome editing with Cas9 in adult mice corrects a disease mutation and phenotype. Nat Biotechnol. Jun. 2014;32(6):551-3. doi: 10.1038/nbt.2884. Epub Mar. 30, 2014.

Young et al., Beyond the canonical 20 amino acids: expanding the genetic lexicon. J Biol Chem. Apr. 9, 2010;285(15):11039-44. doi:10.1074/jbc.R109.091306. Epub Feb. 10, 2010.

Yu et al., Circular permutation: a different way to engineer enzyme structure and function. Trends Biotechnol. Jan. 2011;29(1):18-25. doi: 10.1016/j.tibtech.2010.10.004. Epub Nov. 17, 2010.

Yu et al., Liposome-mediated in vivo E1A gene transfer suppressed dissemination of ovarian cancer cells that overexpress HER-2/neu. Oncogene. Oct. 5, 1995;11(7):1383-8.

Yu et al., Small molecules enhance CRISPR genome editing in pluripotent stem cells. Cell Stem Cell. Feb. 5, 2015;16(2):142-7. doi: 10.1016/j.stem.2015.01.003.

Yu et al., Synthesis-dependent microhomology-mediated end joining accounts for multiple types of repair junctions. Nucleic Acids Res. Sep. 2010;38(17):5706-17. doi: 10.1093/nar/gkq379. Epub May 11, 2010.

Yuan et al., Laboratory-directed protein evolution. Microbiol Mol Biol Rev. 2005; 69(3):373-92. PMID: 16148303.

Yuan et al., Tetrameric structure of a serine integrase catalytic domain. Structure. Aug. 6, 2008;16(8):1275-86. doi: 10.1016/j.str.2008.04.018.

Yuen et al., Control of transcription factor activity and osteoblast differentiation in mammalian cells using an evolved small-molecule-dependent intein. J Am Chem Soc. Jul. 12, 2006;128(27):8939-46.

Zakas et al., Enhancing the pharmaceutical properties of protein drugs by ancestral sequence reconstruction. Nat Biotechnol. Jan. 2017;35(1):35-37. doi: 10.1038/nbt.3677. Epub Sep. 26, 2016.

Zalatan et al., Engineering complex synthetic transcriptional programs with CRISPR RNA scaffolds. Cell. Jan. 15, 2015;160(1-2):339-50. doi: 10.1016/j.cell.2014.11.052. Epub Dec. 18, 2014.

Zelphati et al., Intracellular delivery of proteins with a new lipid-mediated delivery system. J Biol Chem. Sep. 14, 2001;276(37):35103-10. Epub Jul. 10, 2001.

Zetsche et al., A split-Cas9 architecture for inducible genome editing and transcription modulation. Nat Biotechnol. Feb. 2015;33(2):139-42. doi: 10.1038/nbt.3149.

Zetsche et al., Cpf1 is a single RNA-guided endonuclease of a class 2 CRISPR-Cas system. Cell. Oct. 22, 2015;163(3):759-71. doi: 10.1016/j.cell.2015.09.038. Epub Sep. 25, 2015.

Zettler et al., The naturally split Npu DnaE intein exhibits an extraordinarily high rate in the protein trans-splicing reaction. FEBS Lett. Mar. 4, 2009;583(5):909-14. doi: 10.1016/j.febslet.2009.02.003. Epub Feb. 10, 2009.

Zhang et al., Π-Clamp-mediated cysteine conjugation. Nat Chem. Feb. 2016;8(2):120-8. doi: 10.1038/nchem.2413. Epub Dec. 21, 2015.

Zhang et al., Circular intronic long noncoding RNAs. Mol Cell. Sep. 26, 2013;51(6):792-806. doi: 10.1016/j.molcel.2013.08.017. Epub Sep. 12, 2013.

Zhang et al., Comparison of non-canonical PAMs for CRISPR/Cas9-mediated DNA cleavage in human cells. Sci Rep. Jun. 2014;4:5405.

Zhang et al., Conditional gene manipulation: Cre-ating a new biological era. J Zhejiang Univ Sci B. Jul. 2012;13(7):511-24. doi: 10.1631/jzus.B1200042. Review.

Zhang et al., Copy number variation in human health, disease, and evolution. Annu Rev Genomics Hum Genet. 2009;10:451-81. doi: 10.1146/annurev.genom.9.081307.164217.

Zhang et al., CRISPR/Cas9 for genome editing: progress, implications and challenges. Hum Mol Genet. Sep. 15, 2014;23(R1):R40-6. doi: 10.1093/hmg/ddu125. Epub Mar. 20, 2014.

Zhang et al., Efficient construction of sequence-specific TAL effectors for modulating mammalian transcription. Nat Biotechnol. Feb. 2011;29(2):149-53. doi: 10.1038/nbt.1775. Epub Jan. 19, 2011.

Zhang et al., Programmable base editing of zebrafish genome using a modified CRISPR-Cas9 system. Nat Commun. Jul. 25, 2017;8(1):118. doi: 10.1038/s41467-017-00175-6.

Zhang et al., Ribozymes and Riboswitches: Modulation of RNA Function by Small Molecules. Biochemistry. Nov. 2, 2010;49(43):9123-31. doi: 10.1021/bi1012645.

Zhang et al., Stabilized plasmid-lipid particles for regional gene therapy: formulation and transfection properties. Gene Ther. Aug. 1999;6(8):1438-47.

Zhao et al., Crystal structures of a group II intron maturase reveal a missing link in spliceosome evolution. Nat Struct Mol Biol. Jun. 2016;23(6):558-65. doi: 10.1038/nsmb.3224. Epub May 2, 2016.

Zhao et al., Post-transcriptional gene regulation by mRNA modifications. Nat Rev Mol Cell Biol. Jan. 2017;18(1):31-42. doi: 10.1038/nrm.2016.132. Epub Nov. 3, 2016.

Zheng et al., ALKBH5 is a mammalian RNA demethylase that impacts RNA metabolism and mouse fertility. Mol Cell. Jan. 10, 2013;49(1):18-29. doi: 10.1016/j.molcel.2012.10.015. Epub Nov. 21, 2012.

Zheng et al., DNA editing in DNA/RNA hybrids by adenosine deaminases that act on RNA. Nucleic Acids Res. Apr. 7, 2017;45(6):3369-3377. doi: 10.1093/nar/gkx050.

Zhong et al., Rational Design of Aptazyme Riboswitches for Efficient Control of Gene Expression in Mammalian Cells. Elife. Nov. 2, 2016;5:e18858. doi: 10.7554/eLife.18858.

Zhou et al., Dynamic m(6)A mRNA methylation directs translational control of heat shock response. Nature. Oct. 22, 2015;526(7574):591-4. doi: 10.1038/nature15377. Epub Oct. 12, 2015.

Zhou et al., Protective V127 prion variant prevents prion disease by interrupting the formation of dimer and fibril from molecular dynamics simulations. Sci Rep. Feb. 24, 2016;6:21804. doi: 10.1038/srep21804.

(56) References Cited

OTHER PUBLICATIONS

Zimmerly et al., An Unexplored Diversity of Reverse Transcriptases in Bacteria. Microbiol Spectr. Apr. 2015;3(2):MDNA3-0058-2014. doi: 10.1128/microbiolspec.MDNA3-0058-2014.

Zimmerly et al., Group II intron mobility occurs by target DNA-primed reverse transcription. Cell. Aug. 25, 1995;82(4):545-54. doi: 10.1016/0092-8674(95)90027-6.

Zimmermann et al., Molecular interactions and metal binding in the theophylline-binding core of an RNA aptamer. RNA. May 2000;6(5):659-67.

Zong et al., Precise base editing in rice, wheat and maize with a Cas9-cytidine deaminase fusion. Nat Biotechnol. May 2017;35(5):438-440. doi: 10.1038/nbt.3811. Epub Feb. 27, 2017.

Zorko et al., Cell-penetrating peptides: mechanism and kinetics of cargo delivery. Adv Drug Deliv Rev. Feb. 28, 2005;57(4):529-45. Epub Jan. 22, 2005.

Zou et al., Gene targeting of a disease-related gene in human induced pluripotent stem and embryonic stem cells. Cell Stem Cell. Jul. 2, 2009;5(1):97-110. doi: 10.1016/j.stem.2009.05.023. Epub Jun. 18, 2009.

Zufferey et al., Woodchuck hepatitis virus posttranscriptional regulatory element enhances expression of transgenes delivered by retroviral vectors. J Virol. Apr. 1999;73(4):2886-92. doi: 10.1128/JVI.73.4.2886-2892.1999.

Zuker et al., Optimal computer folding of large RNA sequences using thermodynamics and auxiliary information. Nucleic Acids Res. Jan. 10, 1981;9(1):133-48. doi: 10.1093/nar/9.1.133.

Zuo et al., Cytosine base editor generates substantial off-target single-nucleotide variants in mouse embryos. Science. Apr. 19, 2019;364(6437):289-292. doi: 10.1126/science.aav9973. Epub Feb. 28, 2019.

Zuris et al., Cationic lipid-mediated delivery of proteins enables efficient protein-based genome editing in vitro and in vivo. Nat Biotechnol. 2015;33:73-80.

[No Author Listed] NCBI Reference Sequence: WP_001516895.1. Mar. 13, 2021. 2 pages.

[No Author Listed] NCBI Reference Sequence: WP_087959824.1. Oct. 9, 2019. 2 pages.

[No Author Listed], "Lambda DNA" from Catalog & Technical Reference. New England Biolabs Inc. 2002/2003. pp. 133 and 270-273.

[No Author Listed], Gag-Pol polyprotein. UniProtKB/Swiss-Prot No. P03355.5. Sep. 18, 2019. 18 pages.

[No Author Listed], *Homo sapiens* signal transducer and activator of transcription 3 (STAT3), transcript variant 1, mRNA. NCBI Ref Seq No. NM_139276.2. Retrived from https://www.ncbi.nlm.nih.gov/nuccore/nm_139276.2. Feb. 26, 2020. 8 pages.

[No Author Listed], *Mus musculus* (Mouse). UniProtKB Accession No. P51908 (ABEC1_MOUSE). Oct. 1, 1996. 10 pages.

[No Author Listed], MutL homolog 1. UniProtKB Acc. No. F1MPG0. May 3, 2011. Accessible at https://rest.uniprot.org/unisave/F1MPG0?format=txt&versions=1. 1 page.

[No Author Listed], *Streptococcus pyogenes* Cas9 protein. EBI Acc. No. BIR16744. Jan. 21, 2021. 1 page.

[No Author Listed], *Streptococcus pyogenes* Cas9 protein. EBI Acc. No. BIR16747. Jan. 21, 2021. 1 page.

Acharya et al., hMSH2 forms specific mispair-binding complexes with hMSH3 and hMSH6. Proc Natl Acad Sci U S A. Nov. 26, 1996;93(24):13629-34. doi: 10.1073/pnas.93.24.13629.

Ai et al., C-terminal Loop Mutations Determine Folding and Secretion Properties of PCSK9. iMedPub J: Biochem Mol Biol J. Nov. 5, 2016;2(3):17. doi: 10.21767/2471-8084.100026. 12 pages.

Aida et al., Prime editing primarily incudes undesired outcomes in mice. bioRxiv preprint and Supplemental Information. Aug. 6, 2020. Retrieved from www.biorxiv.org. doi: 10.1101/2020.08.06.239723. 40 pages.

Akopian et al., Chimeric recombinases with designed DNA sequence recognition. Proc Natl Acad Sci U S A. Jul. 22, 2003;100(15):8688-91. Epub Jul. 1, 2003.

Ali et al., Novel genetic abnormalities in Bernard-Soulier syndrome in India. Ann Hematol. Mar. 2014;93(3):381-4. doi: 10.1007/s00277-013-1895-x. Epub Sep. 1, 2013.

André et al., Axotomy-induced expression of calcium-activated chloride current in subpopulations of mouse dorsal root ganglion neurons. J Neurophysiol. Dec. 2003;90(6):3764-73. doi: 10.1152/jn.00449.2003. Epub Aug. 27, 2003.

Anzalone et al., Genome editing with CRISPR-Cas nucleases, base editors, transposases and prime editors. Nat Biotechnol. Jul. 2020;38(7):824-844. doi: 10.1038/s41587-020-0561-9. Epub Jun. 22, 2020.

Anzalone et al., Search-and-replace genome editing without double-strand breaks or donor DNA. Nature. Dec. 2019;576(7785):149-157 and Suppl Info. doi: 10.1038/s41586-019-1711-4. Epub Oct. 21, 2019. 72 pages.

Asokan et al., The AAV vector toolkit: poised at the clinical crossroads. Mol Ther. Apr. 2012;20(4):699-708. doi: 10.1038/mt.2011.287. Epub Jan. 24, 2012.

Auricchio et al., Exchange of surface proteins impacts on viral vector cellular specificity and transduction characteristics: the retina as a model. Hum Mol Genet. Dec. 15, 2001;10(26):3075-81. doi: 10.1093/hmg/10.26.3075.

Baba et al., Construction of *Escherichia coli* K-12 in-frame, single-gene knockout mutants: the Keio collection. Mol Syst Biol. 2006;2:2006.0008. doi: 10.1038/msb4100050. Epub Feb. 21, 2006.

Badran et al., In vivo continuous directed evolution. Curr Opin Chem Biol. Feb. 2015;24:1-10. doi: 10.1016/j.cbpa.2014.09.040. Epub Nov. 7, 2014.

Bae et al., Cas-OFFinder: a fast and versatile algorithm that searches for potential off-target sites of Cas9 RNA-guided endonucleases. Bioinformatics. May 15, 2014;30(10):1473-5. doi: 10.1093/bioinformatics/btu048. Epub Jan. 24, 2014.

Bagal et al., Recent progress in sodium channel modulators for pain. Bioorg Med Chem Lett. Aug. 15, 2014;24(16):3690-9. doi: 10.1016/j.bmcl.2014.06.038. Epub Jun. 21, 2014.

Banno et al., Deaminase-mediated multiplex genome editing in *Escherichia coli*. Nat Microbiol. Apr. 2018;3(4):423-429. doi: 10.1038/s41564-017-0102-6. Epub Feb. 5, 2018.

Barmania et al., C-C chemokine receptor type five (CCR5): An emerging target for the control of HIV infection. Appl Transl Genom. May 26, 2013;2:3-16. doi: 10.1016/j.atg.2013.05.004.

Basila et al., Minimal 2'-O-methyl phosphorothioate linkage modification pattern of synthetic guide RNAs for increased stability and efficient CRISPR-Cas9 gene editing avoiding cellular toxicity. PLoS One. Nov. 27, 2017;12(11):e0188593. doi: 10.1371/journal.pone.0188593.

Bass, B.L., RNA editing by adenosine deaminases that act on RNA. Annu Rev Biochem. 2002;71:817-46. doi: 10.1146/annurev.biochem.71.110601.135501. Epub Nov. 9, 2001.

Beaudry et al., Directed evolution of an RNA enzyme. Science. Jul. 31, 1992;257(5070):635-41. doi: 10.1126/science.1496376.

Bell et al., Ribozyme-catalyzed excision of targeted sequences from within RNAs. Biochemistry. Dec. 24, 2002;41(51):15327-33. doi: 10.1021/bi0267386.

Benarroch, HCN channels: function and clinical implications. Neurology. Jan. 15, 2013;80(3):304-10. doi: 10.1212/WNL.0b013e31827dec42.

Bentin, T., A ribozyme transcribed by a ribozyme. Artif DNA PNA XNA. Apr. 2011;2(2):40-42. doi: 10.4161/adna.2.2.16852.

Bertsimas et al., Simulated annealing. Statistical Science. Feb. 1993;8(1):10-15. doi: 10.1214/ss/1177011077.

Bhagwat, DNA-cytosine deaminases: from antibody maturation to antiviral defense. DNA Repair (Amst). Jan. 5, 2004;3(1):85-9.

Bibikova et al., Targeted chromosomal cleavage and mutagenesis in *Drosophila* using zinc-finger nucleases. Genetics. Jul. 2002;161(3):1169-75. doi: 10.1093/genetics/161.3.1169.

Blauw et al., SMN1 gene duplications are associated with sporadic ALS. Neurology. Mar. 13, 2012;78(11):776-80. doi: 10.1212/WNL.0b013e318249f697. Epub Feb. 8, 2012.

Bosch et al., Precise genome engineering in *Drosophila* using prime editing. Proc Natl Acad Sci U S A. Jan. 5, 2021;118(1):e2021996118. doi: 10.1073/pnas.2021996118.

(56) References Cited

OTHER PUBLICATIONS

Bothmer et al., Characterization of the interplay between DNA repair and CRISPR/Cas9-induced DNA lesions at an endogenous locus. Nat Commun. Jan. 9, 2017;8:13905. doi: 10.1038/ncomms13905.
Bourinet et al., Silencing of the Cav3.2 T-type calcium channel gene in sensory neurons demonstrates its major role in nociception. EMBO J. Jan. 26, 2005;24(2):315-24. doi: 10.1038/sj.emboj.7600515. Epub Dec. 16, 2004.
Brierley et al., Viral RNA pseudoknots: versatile motifs in gene expression and replication. Nat Rev Microbiol. Aug. 2007;5(8):598-610. doi: 10.1038/nrmicro1704.
Brutlag et al., Improved sensitivity of biological sequence database searches. Comput Appl Biosci. Jul. 1990;6(3):237-45. doi: 10.1093/bioinformatics/6.3.237.
Burke et al., Activating mutations of Tn3 resolvase marking interfaces important in recombination catalysis and its regulation. Mol Microbiol. Feb. 2004;51(4):937-48.
Burton et al., Gene delivery using herpes simplex virus vectors. DNA Cell Biol. Dec. 2002;21(12):915-36. doi: 10.1089/104454902762053864.
Buskirk et al., In vivo evolution of an RNA-based transcriptional activator. Chem Biol. Jun. 2003;10(6):533-40. doi: 10.1016/s1074-5521(03)00109-1.
Butt et al., Efficient CRISPR/Cas9-Mediated Genome Editing Using a Chimeric Single-Guide RNA Molecule. Front Plant Sci. Aug. 24, 2017;8:1441(1-8). doi: 10.3389/fpls.2017.01441.
Canny et al., Inhibition of 53BP1 Favors Homology-Dependent DNA Repair and Increases CRISPR-Cas9 Genome-Editing Efficiency. Nat Biotechnol. Jan. 2018;36(1):95-102. doi: 10.1038/nbt.4021. Epub Nov. 27, 2017.
Cao et al., Rapamycin reverses cellular phenotypes and enhances mutant protein clearance in Hutchinson-Gilford progeria syndrome cells. Sci Transl Med. Jun. 29, 2011;3(89):89ra58. doi: 10.1126/scitranslmed.3002346.
Carlier et al., Genome Sequence of Burkholderia cenocepacia H111, a Cystic Fibrosis Airway Isolate. Genome Announc. Apr. 10, 2014;2(2):e00298-14. doi: 10.1128/genomeA.00298-14.
Cartegni et al., Determinants of exon 7 splicing in the spinal muscular atrophy genes, SMN1 and SMN2. Am J Hum Genet. Jan. 2006;78(1):63-77. doi: 10.1086/498853. Epub Nov. 16, 2005.
Chan et al., Novel selection methods for DNA-encoded chemical libraries. Curr Opin Chem Biol. 2015;26:55-61. doi:10.1016/j.cbpa.2015.02.010.
Chan et al., The choice of nucleotide inserted opposite abasic sites formed within chromosomal DNA reveals the polymerase activities participating in translesion DNA synthesis. DNA Repair (Amst). Nov. 2013;12(11):878-89. doi: 10.1016/j.dnarep.2013.07.008. Epub Aug. 26, 2013.
Chang et al., Degradation of survival motor neuron (SMN) protein is mediated via the ubiquitin/proteasome pathway. Neurochem Int. Dec. 2004;45(7):1107-12. doi: 10.1016/j.neuint.2004.04.005.
Chari et al., Unraveling CRISPR-Cas9 genome engineering parameters via a library-on-library approach. Nat Methods. Sep. 2015;12(9):823-6. doi: 10.1038/nmeth.3473. Epub Jul. 13, 2015.
Chatterjee et al., A Cas9 with PAM recognition for adenine dinucleotides. Nat Commun. May 18, 2020;11(1):2474. doi: 10.1038/s41467-020-16117-8.
Chatterjee et al., Robust Genome Editing of Single-Base PAM Targets; with Engineered ScCas9 Variants. bioRxiv. doi: 10.1101/620351. Posted Apr. 26, 2019.
Chavez et al., Therapeutic applications of the ΦC31 integrase system. Curr Gene Ther. Oct. 2011;11(5):375-81. Review.
Chawla et al., An atlas of RNA base pairs involving modified nucleobases with optimal geometries and accurate energies. Nucleic Acids Res. Aug. 18, 2015;43(14):6714-29. doi: 10.1093/nar/gkv606. Epub Jun. 27, 2015.
Chen et al., A general strategy for the evolution of bond-forming enzymes using yeast display. Proc Natl Acad Sci U S A. Jul. 12, 2011;108(28):11399-404. doi: 10.1073/pnas.1101046108. Epub Jun. 22, 2011.
Chen et al., Alterations in PMS2, MSH2 and MLH1 expression in human prostate cancer. Int J Oncol. May 2003;22(5):1033-43.
Chen et al., Dynamic imaging of genomic loci in living human cells by an optimized CRISPR/Cas system. Cell. Dec. 19, 2013;155(7):1479-91. doi: 10.1016/j.cell.2013.12.001. Erratum in: Cell. Jan. 16, 2014;156(1-2):373.
Chen et al., Genome-wide CRISPR screen in a mouse model of tumor growth and metastasis. Cell. Mar. 12, 2015;160(6):1246-60. doi: 10.1016/j.cell.2015.02.038. Epub Mar. 5, 2015.
Chen et al., Targeting genomic rearrangements in tumor cells through Cas9-mediated insertion of a suicide gene. Nat Biotechnol. Jun. 2017;35(6):543-550. doi: 10.1038/nbt.3843. Epub May 1, 2017.
Cheng et al., [Cloning,expression and activity identification of human innate immune protein apolipoprotein B mRNA editing enzyme catalytic subunit 3A(APOBEC3A)]. Xi Bao Yu Fen Zi Mian Yi Xue Za Zhi. Chinese Journal of Cellular and Molecular Immunology, Feb. 2017;33(2):179-84. Chinese.
Cheng et al., Multiplexed activation of endogenous genes by CRISPR-on, an RNA-guided transcriptional activator system. Cell Res. Oct. 2013;23(10):1163-71. doi: 10.1038/cr.2013.122. Epub Aug. 27, 2013.
Chester et al., The apolipoprotein B mRNA editing complex performs a multifunctional cycle and suppresses nonsense-mediated decay. EMBO J. Aug. 1, 2003;22(15):3971-82. doi: 10.1093/emboj/cdg369.
Cho et al., A degron created by SMN2 exon 7 skipping is a principal contributor to spinal muscular atrophy severity. Genes Dev. Mar. 1, 2010;24(5):438-42. doi: 10.1101/gad.1884910.
Cho et al., The calcium-activated chloride channel anoctamin 1 acts as a heat sensor in nociceptive neurons. Nat Neurosci. May 27, 2012;15(7):1015-21. doi: 10.1038/nn.3111.
Choi et al., Translesion synthesis across abasic lesions by human B-family and Y-family DNA polymerases α, δ, η, ι, κ, and REV1. J Mol Biol. Nov. 19, 2010;404(1):34-44. doi: 10.1016/j.jmb.2010.09.015. Epub Oct. 1, 2010.
Choudhury et al., CRISPR/Cas9 recombineering-mediated deep mutational scanning of essential genes in *Escherichia coli*. Mol Syst Biol. Mar. 2020;16(3):e9265. doi: 10.15252/msb.20199265.
Choudhury et al., CRISPR-dCas9 mediated TET1 targeting for selective DNA demethylation at BRCA1 promoter. Oncotarget. Jul. 19, 2016;7(29):46545-46556. doi: 10.18632/oncotarget.10234.
Corcia et al., The importance of the SMN genes in the genetics of sporadic ALS. Amyotroph Lateral Scler. Oct.-Dec. 2009;10(5-6):436-40. doi: 10.3109/17482960902759162.
Corti et al., Genetic correction of human induced pluripotent stem cells from patients with spinal muscular atrophy. Sci Transl Med. Dec. 19, 2012;4(165):165ra162. doi: 10.1126/scitranslmed.3004108.
Cox et al., Congenital insensitivity to pain: novel SCN9A missense and in-frame deletion mutations. Hum Mutat. Sep. 2010;31(9):E1670-86. doi: 10.1002/humu.21325.
Cronican et al., A class of human proteins that deliver functional proteins into mammalian cells in vitro and in vivo. Chem Biol. Jul. 29, 2011;18(7):833-8. doi: 10.1016/j.chembiol.2011.07.003.
Cronican et al., Potent delivery of functional proteins into Mammalian cells in vitro and in vivo using a supercharged protein. ACS Chem Biol. Aug. 20, 2010;5(8):747-52. doi:10.1021/cb1001153.
Cucchiarini et al., Enhanced expression of the central survival of motor neuron (SMN) protein during the pathogenesis of osteoarthritis. J Cell Mol Med. Jan. 2014;18(1):115-24. doi: 10.1111/jcmm.12170. Epub Nov. 17, 2013.
Cui et al., Consequences of Cas9 cleavage in the chromosome of *Escherichia coli*. Nucleic Acids Res. May 19, 2016;44(9):4243-51. doi: 10.1093/nar/gkw223. Epub Apr. 8, 2016.
Damdindorj et al., A comparative analysis of constitutive promoters located in adeno-associated viral vectors. PLoS One. Aug. 29, 2014;9(8):e106472. doi: 10.1371/journal.pone.0106472.

(56) References Cited

OTHER PUBLICATIONS

Davidson et al., Viral vectors for gene delivery to the nervous system. Nat Rev Neurosci. May 2003;4(5):353-64. doi: 10.1038/nrn1104.
Davis et al., Assaying Repair at DNA Nicks. Methods Enzymol. 2018;601:71-89. doi: 10.1016/bs.mie.2017.12.001. Epub Feb. 1, 2018.
Davis et al., Homology-directed repair of DNA nicks via pathways distinct from canonical double-strand break repair. Proc Natl Acad Sci U S A. Mar. 11, 2014;111(10):E924-32. doi: 10.1073/pnas.1400236111. Epub Feb. 20, 2014.
Davis et al., Two Distinct Pathways Support Gene Correction by Single-Stranded Donors at DNA Nicks. Cell Rep. Nov. 8, 2016;17(7):1872-1881. doi: 10.1016/j.celrep.2016.10.049.
De La Peña et al., The Hammerhead Ribozyme: A Long History for a Short RNA. Molecules. Jan. 4, 2017;22(1):78. doi: 10.3390/molecules22010078.
De Sandre-Giovannoli et al., Lamin a truncation in Hutchinson-Gilford progeria. Science. Jun. 27, 2003;300(5628):2055. doi: 10.1126/science.1084125. Epub Apr. 17, 2003.
Denizio et al., Harnessing natural DNA modifying activities for editing of the genome and epigenome. Curr Opin Chem Biol. Aug. 2018;45:10-17. doi: 10.1016/j.cbpa.2018.01.016. Epub Feb. 13, 2018.
Deverman et al., Cre-dependent selection yields AAV variants for widespread gene transfer to the adult brain. Nat Biotechnol. Feb. 2016;34(2):204-9. doi: 10.1038/nbt.3440. Epub Feb. 1, 2016.
Devigili et al., Paroxysmal itch caused by gain-of-function Nav1.7 mutation. Pain. Sep. 2014;155(9):1702-1707. doi: 10.1016/j.pain.2014.05.006. Epub May 10, 2014.
Dianov et al., Mammalian base excision repair: the forgotten archangel. Nucleic Acids Res. Apr. 1, 2013;41(6):3483-90. doi: 10.1093/nar/gkt076. Epub Feb. 13, 2013.
Dickinson et al., A system for the continuous directed evolution of proteases rapidly reveals drug-resistance mutations. Nat Commun. Oct. 30, 2014;5:5352. doi: 10.1038/ncomms6352.
Ding et al., Gene therapy for cardiovascular disease. Journal of Shanghai University (Natural Science Edition) . 2016;3:270-9 . DOI: 10.3969/j.issn.1007-2861.2016.03.013.
Doench et al., Rational design of highly active sgRNAs for CRISPR-Cas9-mediated gene inactivation. Nat Biotechnol. Dec. 2014;32(12):1262-7. doi: 10.1038/nbt.3026. Epub Sep. 3, 2014.
Dolan et al., Trans-splicing with the group I intron ribozyme from Azoarcus. RNA. Feb. 2014;20(2):202-13. doi: 10.1261/rna.041012.113. Epub Dec. 16, 2013.
Doman et al., Evaluation and minimization of Cas9-independent off-target DNA editing by cytosine base editors. Nat Biotechnol. May 2020;38(5):620-628. doi: 10.1038/s41587-020-0414-6. Epub Feb. 10, 2020.
Dorr et al., Reprogramming the specificity of sortase enzymes. Proc Natl Acad Sci U S A. Sep. 16, 2014;111(37):13343-8. doi: 10.1073/pnas.1411179111. Epub Sep. 3, 2014.
Doudna, The promise and challenge of therapeutic genome editing. Nature. Feb. 2020;578(7794):229-236. doi: 10.1038/s41586-020-1978-5. Epub Feb. 12, 2020.
Drenth et al., Mutations in sodium-channel gene SCN9A cause a spectrum of human genetic pain disorders. J Clin Invest. Dec. 2007;117(12):3603-9. doi: 10.1172/JCI33297.
Drost et al., Inactivation of DNA mismatch repair by variants of uncertain significance in the PMS2 gene. Hum Mutat. Nov. 2013;34(11):1477-80. doi: 10.1002/humu.22426. Epub Sep. 11, 2013.
Duan et al., Enhancement of muscle gene delivery with pseudotyped adeno-associated virus type 5 correlates with myoblast differentiation. J Virol. Aug. 2001;75(16):7662-71. doi: 10.1128/JVI.75.16.7662-7671.2001.
Dugar et al., CRISPR RNA-Dependent Binding and Cleavage of Endogenous RNAs by the Campylobacter jejuni Cas9. Mol Cell. Mar. 1, 2018;69(5):893-905.e7. doi: 10.1016/j.molcel.2018.01.032.

D'Ydewalle et al., The Antisense Transcript SMN-AS1 Regulates SMN Expression and Is a Novel Therapeutic Target for Spinal Muscular Atrophy. Neuron. Jan. 4, 2017;93(1):66-79 and Supplemental Information. doi: 10.1016/j.neuron.2016.11.033. Epub Dec. 22, 2016.
Edraki et al., A Compact, High-Accuracy Cas9 with a Dinucleotide PAM for In Vivo Genome Editing. Mol Cell. Feb. 21, 2019;73(4):714-726.e4 and Supplemental Info. doi: 10.1016/j.molcel.2018.12.003. Epub Dec. 20, 2018.
Eisenberg et al., A-to-I RNA editing—immune protector and transcriptome diversifier. Nat Rev Genet. Aug. 2018;19(8):473-490. doi: 10.1038/s41576-018-0006-1.
Ekstrand et al., Frequent alterations of the PI3K/AKT/mTOR pathways in hereditary nonpolyposis colorectal cancer. Fam Cancer. Jun. 2010;9(2):125-9. doi: 10.1007/s10689-009-9293-1.
Emery et al., HCN2 ion channels play a central role in inflammatory and neuropathic pain. Science. Sep. 9, 2011;333(6048):1462-6. doi: 10.1126/science.1206243.
Entin-Meer et al., The role of phenylalanine-119 of the reverse transcriptase of mouse mammary tumour virus in DNA synthesis, ribose selection and drug resistance. Biochem J. Oct. 15, 2002;367(Pt 2):381-91. doi: 10.1042/BJ20020712.
Epstein, HSV-1-based amplicon vectors: design and applications. Gene Ther. Oct. 2005;12 Suppl 1:S154-8. doi: 10.1038/sj.gt.3302617.
Estacion et al., A sodium channel gene SCN9A polymorphism that increases nociceptor excitability. Ann Neurol. Dec. 2009;66(6):862-6. doi: 10.1002/ana.21895.
Fang et al., Human strand-specific mismatch repair occurs by a bidirectional mechanism similar to that of the bacterial reaction. J Biol Chem. Jun. 5, 1993;268(16):11838-44.
Fang et al., The Menu of Features that Define Primary MicroRNAs and Enable De Novo Design of MicroRNA Genes. Mol Cell. Oct. 1, 2015;60(1):131-45. doi: 10.1016/j.molcel.2015.08.015. Epub Sep. 24, 2015.
Farboud et al., Dramatic enhancement of genome editing by CRISPR/Cas9 through improved guide RNA design. Genetics. Apr. 2015;199(4):959-71. doi: 10.1534/genetics.115.175166. Epub Feb. 18, 2015.
Feng et al., Efficient genome editing in plants using a CRISPR/Cas system. Cell Res. Oct. 2013;23(10):1229-32. doi: 10.1038/cr.2013.114. Epub Aug. 20, 2013.
Filippova et al., Guide RNA modification as a way to improve CRISPR/Cas9-based genome-editing systems. Biochimie. Dec. 2019;167:49-60. doi: 10.1016/j.biochi.2019.09.003. Epub Sep. 4, 2019.
Fischbach et al., Directed evolution can rapidly improve the activity of chimeric assembly-line enzymes. Proc Natl Acad Sci U S A. Jul. 17, 2007;104(29):11951-6. doi: 10.1073/pnas.0705348104. Epub Jul. 9, 2007.
Fishel et al., The human mutator gene homolog MSH2 and its association with hereditary nonpolyposis colon cancer. Cell. Dec. 3, 1993;75(5):1027-38. doi: 10.1016/0092-8674(93)90546-3. Erratum in: Cell. Apr. 8, 1994;77(1):1 p following 166.
Flynn et al., CRISPR-mediated genotypic and phenotypic correction of a chronic granulomatous disease mutation in human iPS cells. Exp Hematol. Oct. 2015;43(10):838-848.e3. doi: 10.1016/j.exphem.2015.06.002. Epub Jun. 19, 2015. Including supplementary figures and data.
Fortini et al., Different DNA polymerases are involved in the short- and long-patch base excision repair in mammalian cells. Biochemistry. Mar. 17, 1998;37(11):3575-80. doi: 10.1021/bi972999h.
Friedman, J. H., Greedy function approximation: A gradient boosting machine. Ann. Statist. Oct. 2001;29(5):1189-232. doi: 10.1214/aos/1013203451.
Fu et al., Targeted genome editing in human cells using CRISPR/Cas nucleases and truncated guide RNAs. Methods Enzymol. 2014;546:21-45. doi: 10.1016/B978-0-12-801185-0.00002-7.
Fusi et al., In Silico Predictive Modeling of CRISPR/Cas9 guide efficiency. Jun. 26, 2015; bioRxiv. http://dx.doi.org/10.1101/021568.

(56) References Cited

OTHER PUBLICATIONS

Gaj et al., Structure-guided reprogramming of serine recombinase DNA sequence specificity. Proc Natl Acad Sci U S A. Jan. 11, 2011;108(2):498-503. doi: 10.1073/pnas.1014214108. Epub Dec. 27, 2010.
Gangopadhyay et al., Precision Control of CRISPR-Cas9 Using Small Molecules and Light. Biochemistry. Jan. 29, 2019;58(4):234-244. doi: 10.1021/acs.biochem.8b01202. Epub Jan. 22, 2019.
Gao et al., Prime editing in mice reveals the essentiality of a single base in driving tissue-specific gene expression. Genome Biol. Mar. 16, 2021;22(1):83. doi: 10.1186/s13059-021-02304-3.
Gapinske et al., CRISPR-SKIP: programmable gene splicing with single base editors. Genome Biol. Aug. 15, 2018;19(1):107. doi: 10.1186/s13059-018-1482-5.
Gaudelli et al., Directed evolution of adenine base editors with increased activity and therapeutic application. Nat Biotechnol. Jul. 2020;38(7):892-900. doi: 10.1038/s41587-020-0491-6. Epub Apr. 13, 2020.
Gearing, Addgene blog. CRISPR 101: Cas9 nickase design and homology directed repair. 2018. pp. 1-12. https://blog.addgene.org/crispr-101-cas9-nickase-design-and-homolgy-directed-repair. Last retrieved online Jun. 25, 2021.
Geisberg et al., Global analysis of mRNA isoform half-lives reveals stabilizing and destabilizing elements in yeast. Cell. Feb. 13, 2014;156(4):812-24. doi: 10.1016/j.cell.2013.12.026.
Genbank Submission; NIH/NCBI Accession No. 4UN5_B. Anders et al., Jul. 23, 2014. 5 pages.
Genbank Submission; NIH/NCBI, Accession No. AIT42264.1. Hyun et al., Oct. 15, 2014. 2 pages.
Genbank Submission; NIH/NCBI, Accession No. AKA60242.1. Tong et al., Apr. 5, 2015. 1 page.
Genbank Submission; NIH/NCBI, Accession No. AKQ21048.1. Gilles et al., Jul. 19, 2015. 1 page.
Genbank Submission; NIH/NCBI, Accession No. AKS40380.1. Nodvig et al., Aug. 2, 2015. 1 page.
Genbank Submission; NIH/NCBI, Accession No. NC_000001.11. Gregory et al., Jun. 6, 2016. 3 pages.
Genbank Submission; NIH/NCBI, Accession No. NG_008692.2. McClintock et al., Aug. 27, 2018. 33 pages.
Genbank Submission; NIH/NCBI, Accession No. NM_002945.3. Weiser et al., Sep. 3, 2017. 5 pages.
Genbank Submission; NIH/NCBI, Accession No. NM_002947.4. Xiao et al., May 1, 2019. 4 pages.
Genbank Submission; NIH/NCBI, Accession No. NM_003686.4. Umar et al., Apr. 9, 2021. 7 pages.
Genbank Submission; NIH/NCBI, Accession No. NM_206933.2. Khalaileh et al., Sep. 16, 2018. 12 pages.
Genbank Submission; NIH/NCBI, Accession No. NP_001075493.1. Schiaffella et al., Jun. 24, 2018. 2 pages.
Genbank Submission; NIH/NCBI, Accession No. NP_001157741.1. Zeng et al., Sep. 17, 2018. 3 pages.
Genbank Submission; NIH/NCBI, Accession No. NP_001157742.1. Zeng et al., Oct. 21, 2018. 3 pages.
Genbank Submission; NIH/NCBI, Accession No. NP_033040.2. Liu et al., Jun. 23, 2018. 2 pages.
Genbank Submission; NIH/NCBI, Accession No. NP_358988.1. Hoskins et al., Jan. 11, 2017. 2 pages.
Genbank Submission; NIH/NCBI, Accession No. NP_391970.1. Borriss et al., Feb. 12, 2021. 3 pages.
Genbank Submission; NIH/NCBI, Accession No. NP_628093.1. Hsiao et al., Aug. 3, 2016. 2 pages.
Genbank Submission; NIH/NCBI, Accession No. NP_996816.2. Fu et al., Sep. 22, 2019. 9 pages.
Genbank Submission; NIH/NCBI, Accession No. WP_002989955.1. No Author Listed, May 6, 2013. 1 page.
Genbank Submission; NIH/NCBI, Accession No. WP_010922251.1. No Author Listed, May 15, 2013. 1 page.
Genbank Submission; NIH/NCBI, Accession No. WP_011054416.1. No Author Listed, May 15, 2013. 1 page.
Genbank Submission; NIH/NCBI, Accession No. WP_011284745.1. No Author Listed, May 16, 2013. 1 page.
Genbank Submission; NIH/NCBI, Accession No. WP_011285506.1. No Author Listed, May 16, 2013. 1 page.
Genbank Submission; NIH/NCBI, Accession No. WP_011527619.1. No Author Listed, May 16, 2013. 1 page.
Genbank Submission; NIH/NCBI, Accession No. WP_012560673.1. No Author Listed, May 17, 2013. 1 page.
Genbank Submission; NIH/NCBI, Accession No. WP_014407541.1. No Author Listed, May 18, 2013. 1 page.
Genbank Submission; NIH/NCBI, Accession No. WP_020905136.1. No Author Listed, Jul. 25, 2013. 1 page.
Genbank Submission; NIH/NCBI, Accession No. WP_023080005.1. No Author Listed, Oct. 27, 2013. 1 page.
Genbank Submission; NIH/NCBI, Accession No. WP_023610282.1. No Author Listed, Nov. 27, 2013. 1 page.
Genbank Submission; NIH/NCBI, Accession No. WP_030125963.1. No Author Listed, Jul. 9, 2014. 1 page.
Genbank Submission; NIH/NCBI, Accession No. WP_030126706.1. No Author Listed, Jul. 9, 2014. 1 page.
Genbank Submission; NIH/NCBI, Accession No. WP_031488318.1. No Author Listed., Aug. 5, 2014. 1 page.
Genbank Submission; NIH/NCBI, Accession No. WP_032460140.1. No Author Listed, Oct. 4, 2014. 1 page.
Genbank Submission; NIH/NCBI, Accession No. WP_032461047.1. No Author Listed, Oct. 4, 2014. 1 page.
Genbank Submission; NIH/NCBI, Accession No. WP_032462016.1. Haft et al., Oct. 4, 2014. 1 page.
Genbank Submission; NIH/NCBI, Accession No. WP_032462936.1. No Author Listed, Oct. 4, 2014. 1 page.
Genbank Submission; NIH/NCBI, Accession No. WP_032464890.1. No Author Listed, Oct. 4, 2014. 1 page.
Genbank Submission; NIH/NCBI, Accession No. WP_038431314.1. No Author Listed, Dec. 26, 2014. 1 page.
Genbank Submission; NIH/NCBI, Accession No. WP_038432938.1. No Author Listed, Dec. 26, 2014. 1 page.
Genbank Submission; NIH/NCBI, Accession No. WP_038434062.1. No Author Listed, Dec. 26, 2014. 1 page.
Genbank Submission; NIH/NCBI, Accession No. WP_048327215.1. No Author Listed, Jun. 26, 2015. 1 page.
Genbank Submission; NIH/NCBI, Accession No. WP_049519324.1. No Author Listed, Jul. 20, 2015. 1 page.
Genbank Submission; NIH/NCBI, Accession No. XP_003314669.1. No Author Listed, Mar. 20, 2018. 2 pages.
Genbank Submission; NIH/NCBI, Accession No. XP_026671085.1. No Author Listed, Oct. 17, 2018. 1 page.
Genbank Submission; NIH/NCBI, Accession No. YP_009137104.1. Davison, Aug. 13, 2018. 2 pages.
Geng et al., In vitro studies of DNA mismatch repair proteins. Anal Biochem. Jun. 15, 2011;413(2):179-84. doi: 10.1016/j.ab.2011.02.017. Epub Feb. 15, 2011.
Genschel et al., Human exonuclease I is required for 5' and 3' mismatch repair. J Biol Chem. Apr. 12, 2002;277(15):13302-11. doi: 10.1074/jbc.M111854200. Epub Jan. 24, 2002.
Genschel et al., Isolation of MutSbeta from human cells and comparison of the mismatch repair specificities of MutSbeta and MutSalpha. J Biol Chem. Jul. 31, 1998;273(31):19895-901. doi: 10.1074/jbc.273.31.19895. Erratum in: J Biol Chem Oct. 9, 1998;273(41):27034.
Goldberg et al., Loss-of-function mutations in the Nav1.7 gene underlie congenital indifference to pain in multiple human populations. Clin Genet. Apr. 2007;71(4):311-9. doi: 10.1111/j.1399-0004.2007.00790.x.
Gordley et al., Evolution of programmable zinc finger-recombinases with activity in human cells. J Mol Biol. Mar. 30, 2007;367(3):802-13. Epub Jan. 12, 2007.
Gordley et al., Synthesis of programmable integrases. Proc Natl Acad Sci U S A. Mar. 31, 2009;106(13):5053-8. doi: 10.1073/pnas.0812502106. Epub Mar. 12, 2009.
Grati et al., Localization of PDZD7 to the stereocilia ankle-link associates this scaffolding protein with the Usher syndrome protein network. J Neurosci. Oct. 10, 2012;32(41):14288-93. doi: 10.1523/JNEUROSCI.3071-12.2012.

(56) References Cited

OTHER PUBLICATIONS

Green et al., Characterization of the mechanical unfolding of RNA pseudoknots. J Mol Biol. Jan. 11, 2008;375(2):511-28. doi: 10.1016/j.jmb.2007.05.058. Epub May 26, 2007.

Grindley et al., Mechanisms of site-specific recombination. Annu Rev Biochem. 2006;75:567-605. doi: 10.1146/annurev.biochem.73.011303.073908.

Groher et al., Synthetic riboswitches—A tool comes of age. Biochim Biophys Acta. Oct. 2014;1839(10):964-973. doi: 10.1016/j.bbagrm.2014.05.005. Epub May 17, 2014.

Groth et al., Phage integrases: biology and applications. J Mol Biol. Jan. 16, 2004;335(3):667-78.

Gruber et al., The Vienna RNA websuite. Nucleic Acids Res. Jul. 1, 2008;36(Web Server issue):W70-4. doi: 10.1093/nar/gkn188. Epub Apr. 19, 2008.

Guedon et al., Current gene therapy using viral vectors for chronic pain. Mol Pain. May 13, 2015;11:27. doi: 10.1186/s12990-015-0018-1.

Gueneau et al., Structure of the MutLα C-terminal domain reveals how Mlh1 contributes to Pms1 endonuclease site. Nat Struct Mol Biol. Apr. 2013;20(4):461-8. doi: 10.1038/nsmb.2511. Epub Feb. 24, 2013.

Guerrette et al., The interaction of the human MutL homologues in hereditary nonpolyposis colon cancer. J Biol Chem. Mar. 5, 1999;274(10):6336-41. doi: 10.1074/jbc.274.10.6336.

Guo et al., Evolution of Tetrahymena ribozyme mutants with increased structural stability. Nat Struct Biol. Nov. 2002;9(11):855-61. doi: 10.1038/nsb850.

Guo et al., Structure of Cre recombinase complexed with DNA in a site-specific recombination synapse. Nature. Sep. 4, 1997;389(6646):40-6.

Gupta et al., Mechanism of mismatch recognition revealed by human MutSβ bound to unpaired DNA loops. Nat Struct Mol Biol. Dec. 18, 2011;19(1):72-8. doi: 10.1038/nsmb.2175.

Gutschner et al., Post-translational Regulation of Cas9 during G1 Enhances Homology-Directed Repair. Cell Rep. Feb. 16, 2016;14(6):1555-1566. doi: 10.1016/j.celrep.2016.01.019. Epub Feb. 4, 2016.

Hagen et al., A high rate of polymerization during synthesis of mouse mammary tumor virus DNA alleviates hypermutation by APOBEC3 proteins. PLoS Pathog. Feb. 15, 2019;15(2):e1007533. doi: 10.1371/journal.ppat.1007533.

Halbert et al., Repeat transduction in the mouse lung by using adeno-associated virus vectors with different serotypes. J Virol. Feb. 2000;74(3):1524-32. doi: 10.1128/jvi.74.3.1524-1532.2000.

Hanna et al., Massively parallel assessment of human variants with base editor screens. Cell. Feb. 18, 2021;184(4):1064-1080.e20. doi: 10.1016/j.cell.2021.01.012.

Hänsel-Hertsch et al., DNA G-quadruplexes in the human genome: detection, functions and therapeutic potential. Nat Rev Mol Cell Biol. May 2017;18(5):279-284. doi: 10.1038/nrm.2017.3. Epub Feb. 22, 2017.

Hardt et al.,Missense variants in hMLH1 identified in patients from the German HNPCC consortium and functional studies. Fam Cancer. Jun. 2011;10(2):273-84. doi: 10.1007/s10689-011-9431-4.

Harmsen et al., DNA mismatch repair and oligonucleotide end-protection promote base-pair substitution distal from a CRISPR/Cas9-induced DNA break. Nucleic Acids Res. Apr. 6, 2018;46(6):2945-2955. doi: 10.1093/nar/gky076.

Harrington et al., Programmed DNA destruction by miniature CRISPR-Cas14 enzymes. Science. Nov. 16, 2018;362(6416):839-842. doi: 10.1126/science.aav4294. Epub Oct. 18, 2018.

Hart et al., High-Resolution CRISPR Screens Reveal Fitness Genes and Genotype-Specific Cancer Liabilities. Cell. Dec. 3, 2015;163(6):1515-26. doi: 10.1016/j.cell.2015.11.015. Epub Nov. 25, 2015.

Hartung et al., Cre mutants with altered DNA binding properties. J Biol Chem. Sep. 4, 1998;273(36):22884-91.

Hawley-Nelson et al., Transfection of Cultured Eukaryotic Cells Using Cationic Lipid Reagents. Curr Prot Mol Biol. Jan. 2008;9.4.1-9.4.17. doi: 10.102/0471142727.mb0904s81. 17 pages.

Hendel et al., Chemically modified guide RNAs enhance CRISPR-Cas genome editing in human primary cells. Nat Biotechnol. Sep. 2015;33(9):985-989. doi: 10.1038/nbt.3290. Epub Jun. 29, 2015. Author Manuscript. 14 pages.

Heyer et al., Regulation of homologous recombination in eukaryotes. Annu Rev Genet. 2010;44:113-39. doi: 10.1146/annurev-genet-051710-150955. Author Manuscript. 33 pages.

Higgs et al., Genetic complexity in sickle cell disease. Proc Natl Acad Sci U S A. Aug. 19, 2008;105(33):11595-6. doi: 10.1073/pnas.0806633105. Epub Aug. 11, 2008.

Hilbers et al., New developments in structure determination of pseudoknots. Biopolymers. 1998;48(2-3):137-53. doi: 10.1002/(SICI)1097-0282(1998)48:2<137::AID-BIP4>3.0.CO;2-H.

Hirano et al., Site-specific recombinases as tools for heterologous gene integration. Appl Microbiol Biotechnol. Oct. 2011;92(2):227-39. doi: 10.1007/s00253-011-3519-5. Epub Aug. 7, 2011. Review.

Hoess et al., DNA specificity of the Cre recombinase resides in the 25 kDa carboxyl domain of the protein. J Mol Biol. Dec. 20, 1990;216(4):873-82. doi: 10.1016/S0022-2836(99)80007-2.

Holt et al., Human hematopoietic stem/progenitor cells modified by zinc-finger nucleases targeted to CCR5 control HIV-1 in vivo. Nat Biotechnol. Aug. 2010;28(8):839-47. doi: 10.1038/nbt.1663. Epub Jul. 2, 2010.

Hotta et al., [Neurotropic viruses—classification, structure and characteristics]. Nihon Rinsho. Apr. 1997;55(4):777-82. Japanese.

Houck-Loomis et al., An equilibrium-dependent retroviral mRNA switch regulates translational recoding. Nature. Nov. 27, 2011;480(7378):561-4. doi: 10.1038/nature10657.

Housden et al., Identification of potential drug targets for tuberous sclerosis complex by synthetic screens combining CRISPR-based knockouts with RNAi. Sci Signal. Sep. 8, 2015;8(393):rs9. doi: 10.1126/scisignal.aab3729.

Houseley et al., The many pathways of RNA degradation. Cell. Feb. 20, 2009;136(4):763-76. doi: 10.1016/j.cell.2009.01.019.

Hsu et al., PrimeDesign software for rapid and simplified design of prime editing guide RNAs. Nat Commun. Feb. 15, 2021;12(1):1034. doi: 10.1038/s41467-021-21337-7.

Hu et al., Evolved Cas9 variants with broad PAM compatibility and high DNA specificity. Nature. Apr. 5, 2018;556(7699):57-63 and Extended/Supplementary Data. doi: 10.1038/nature26155. Epub Feb. 28, 2018. 21 pages.

Hua et al., Expanding the base editing scope in rice by using Cas9 variants. Plant Biotechnol J. Feb. 2019;17(2):499-504. doi: 10.1111/pbi.12993. Epub Oct. 5, 2018.

Hua et al., Precise A•T to G•C Base Editing in the Rice Genome. Mol Plant. Apr. 2, 2018;11(4):627-630. doi: 10.1016/j.molp.2018.02.007. Epub Feb. 21, 2018.

Huang et al., Gain-of-function mutations in sodium channel Na(v)1.9 in painful neuropathy. Brain. Jun. 2014;137(Pt 6):1627-42. doi: 10.1093/brain/awu079. Epub Apr. 27, 2014.

Huang et al., Precision genome editing using cytosine and adenine base editors in mammalian cells. Nat Protoc. Feb. 2021;16(2):1089-1128. doi: 10.1038/s41596-020-00450-9. Epub Jan. 18, 2021.

Humbel et al., Maximizing lentiviral vector gene transfer in the CNS. Gene Ther. Feb. 2021;28(1-2):75-88. doi: 10.1038/s41434-020-0172-6. Epub Jul. 6, 2020. Erratum in: Gene Ther. May 2022;29(5):312.

Iaccarino et al., hMSH2 and hMSH6 play distinct roles in mismatch binding and contribute differently to the ATPase activity of hMutSalpha. EMBO J. May 1, 1998;17(9):2677-86. doi: 10.1093/emboj/17.9.2677.

Ibrahim et al., RNA recognition by 3'-to-5' exonucleases: the substrate perspective. Biochim Biophys Acta. Apr. 2008;1779(4):256-65. doi: 10.1016/j.bbagrm.2007.11.004. Epub Dec. 3, 2007.

Isaacs et al., Engineered riboregulators enable post-transcriptional control of gene expression. Nat Biotechnol. Jul. 2004;22(7):841-7. doi: 10.1038/nbt986. Epub Jun. 20, 2004.

Ishizuka et al., Loss of ADAR1 in tumours overcomes resistance to immune checkpoint blockade. Nature. Jan. 2019;565(7737):43-48. doi: 10.1038/s41586-018-0768-9. Epub Dec. 17, 2018.

(56) References Cited

OTHER PUBLICATIONS

Iyama et al., DNA repair mechanisms in dividing and non-dividing cells. DNA Repair (Amst). Aug. 2013;12(8):620-36. doi: 10.1016/j.dnarep.2013.04.015. Epub May 16, 2013.
Iyer et al., DNA mismatch repair: functions and mechanisms. Chem Rev. Feb. 2006;106(2):302-23. doi: 10.1021/cr0404794.
Jakimo et al., A Cas9 with Complete PAM Recognition for Adenine Dinucleotides. bioRxiv preprint. Sep. 27, 2018. doi.org/10.1101/429654. 29 pages.
Jeong et al., Measurement of deoxyinosine adduct: Can it be a reliable tool to assess oxidative or nitrosative DNA damage? Toxicol Lett. Oct. 17, 2012;214(2):226-33. doi: 10.1016/j.toxlet.2012.08.013. Epub Aug. 23, 2012.
Jia et al., The MLH1 ATPase domain is needed for suppressing aberrant formation of interstitial telomeric sequences. DNA Repair (Amst). May 2018;65:20-25. doi: 10.1016/j.dnarep.2018.03.002. Epub Mar. 7, 2018.
Jiang et al., Chemical modifications of adenine base editor mRNA and guide RNA expand its application scope. Nat Commun. Apr. 24, 2020;11(1):1979. doi: 10.1038/s41467-020-15892-8.
Jiang et al., Prime editing efficiently generates W542L and S621I double mutations in two ALS genes of maize. bioRxiv preprint. Jul. 6, 2020. Retrieved from www.biorxiv.org. doi: 10.1101/2020.07.06.188896. 15 pages.
Jiricny, The multifaceted mismatch-repair system. Nat Rev Mol Cell Biol. May 2006;7(5):335-46. doi: 10.1038/nrm1907.
Johnson et al., Trans insertion-splicing: ribozyme-catalyzed insertion of targeted sequences into RNAs. Biochemistry. Aug. 9, 2005;44(31):10702-10. doi: 10.1021/bi0504815.
Jost et al., Titrating gene expression using libraries of systematically attenuated CRISPR guide RNAs. Nat Biotechnol. Mar. 2020;38(3):355-364. doi: 10.1038/s41587-019-0387-5. Epub Jan. 13, 2020.
Kadyrov et al., Endonucleolytic function of MutLalpha in human mismatch repair. Cell. Jul. 28, 2006;126(2):297-308. doi: 10.1016/j.cell.2006.05.039.
Kan et al., Mechanisms of precise genome editing using oligonucleotide donors. Genome Res. Jul. 2017;27(7):1099-1111. doi: 10.1101/gr.214775.116. Epub Mar. 29, 2017.
Kang et al., Precision genome engineering through adenine base editing in plants. Nat Plants. Jul. 2018;4(7):427-431. doi: 10.1038/s41477-018-0178-x. Epub Jun. 4, 2018. Erratum in: Nat Plants. Sep. 2018;4(9):730.
Katafuchi et al., DNA polymerases involved in the incorporation of oxidized nucleotides into DNA: their efficiency and template base preference. Mutat Res. Nov. 28, 2010;703(1):24-31. doi: 10.1016/j.mrgentox.2010.06.004. Epub Jun. 11, 2010.
Kavli et al., Excision of cytosine and thymine from DNA by mutants of human uracil-DNA glycosylase. EMBO J. Jul. 1, 1996;15(13):3442-7.
Kay et al., Viral vectors for gene therapy: the art of turning infectious agents into vehicles of therapeutics. Nat Med. Jan. 2001;7(1):33-40.
Ketha et al., Application of bioinformatics-coupled experimental analysis reveals a new transport-competent nuclear localization signal in the nucleoprotein of Influenza A virus strain. BMC Cell Biol. Apr. 28, 2008; 9:22. https://doi.org/10.1186/1471-2121-9-22.
Kilbride et al., Determinants of product topology in a hybrid Cre-Tn3 resolvase site-specific recombination system. J Mol Biol. Jan. 13, 2006;355(2):185-95. Epub Nov. 9, 2005.
Kim et al., Adenine base editors catalyze cytosine conversions in human cells. Nat Biotechnol. Oct. 2019;37(10):1145-1148. doi: 10.1038/s41587-019-0254-4. Epub Sep. 23, 2019.
Kim et al., An anionic human protein mediates cationic liposome delivery of genome editing proteins into mammalian cells. Nat Commun. Jul. 2, 2019;10(1):2905. doi: 10.1038/s41467-019-10828-3.
Kim et al., High-throughput analysis of the activities of xCas9, SpCas9-NG and SpCas9 at matched and mismatched target sequences in human cells. Nat Biomed Eng. Jan. 2020;4(1):111-124. doi: 10.1038/s41551-019-0505-1. Epub Jan. 14, 2020.
Kim et al., In vivo genome editing with a small Cas9 orthologue derived from Campylobacter jejuni. Nat Commun. Feb. 21, 2017;8:14500. doi: 10.1038/ncomms14500. PMID: 28220790; PMCID: PMC5473640.
Kim et al., Predicting the efficiency of prime editing guide RNAs in human cells. Nat Biotechnol. Feb. 2021;39(2):198-206. doi: 10.1038/s41587-020-0677-y. Epub Sep. 21, 2020.
Kim et al., RAD51 mutants cause replication defects and chromosomal instability. Mol Cell Biol. Sep. 2012;32(18):3663-80. doi: 10.1128/MCB.00406-12. Epub Jul. 9, 2012.
King et al., No gain, no pain: NaV1.7 as an analgesic target. ACS Chem Neurosci. Sep. 17, 2014;5(9):749-51. doi: 10.1021/cn500171p. Epub Aug. 11, 2014.
Kleinstiver et al., Engineered CRISPR-Cas9 nucleases with altered PAM specificities. Nature. Jul. 23, 2015;523(7561):481-5 and Supplementary Materials. doi: 10.1038/nature14592. Epub Jun. 22, 2015. 27 pages.
Kluesner et al., CRISPR-Cas9 cytidine and adenosine base editing of splice-sites mediates highly-efficient disruption of proteins in primary and immortalized cells. Nat Commun. Apr. 23, 2021;12(1):2437. doi: 10.1038/s41467-021-22009-2.
Knott et al., CRISPR-Cas guides the future of genetic engineering. Science. Aug. 31, 2018;361(6405):866-869. doi: 10.1126/science.aat5011.
Koblan et al., In vivo base editing rescues Hutchinson-Gilford progeria syndrome in mice. Nature. Jan. 2021;589(7843):608-614. doi: 10.1038/s41586-020-03086-7. Epub Jan. 6, 2021.
Konishi et al., Amino acid substitutions away from the RNase H catalytic site increase the thermal stability of Moloney murine leukemia virus reverse transcriptase through RNase H inactivation. Biochem Biophys Res Commun. Nov. 14, 2014;454(2):269-74. doi: 10.1016/j.bbrc.2014.10.044. Epub Oct. 17, 2014.
Ku et al., Nucleic Acid Aptamers: An Emerging Tool for Biotechnology and Biomedical Sensing. Sensors (Basel). Jul. 6, 2015;15(7):16281-313. doi: 10.3390/s150716281.
Kuan et al., A systematic evaluation of nucleotide properties for CRISPR sgRNA design. BMC Bioinformatics. Jun. 6, 2017;18(1):297. doi: 10.1186/s12859-017-1697-6.
Kumar et al., Gene therapy for chronic neuropathic pain: how does it work and where do we stand today? Pain Med. May 2011;12(5):808-22. doi: 10.1111/j.1526-4637.2011.01120.x.
Kunkel et al., DNA mismatch repair. Annu Rev Biochem. 2005;74:681-710. doi: 10.1146/annurev.biochem.74.082803.133243.
Kweon et al., A CRISPR-based base-editing screen for the functional assessment of BRCA1 variants. Oncogene. Jan. 2020;39(1):30-35. doi: 10.1038/s41388-019-0968-2. Epub Aug. 29, 2019.
Kwok et al., G-Quadruplexes: Prediction, Characterization, and Biological Application. Trends Biotechnol. Oct. 2017;35(10):997-1013. doi: 10.1016/j.tibtech.2017.06.012. Epub Jul. 26, 2017.
Lahue et al., DNA mismatch correction in a defined system. Science. Jul. 14, 1989;245(4914):160-4. doi: 10.1126/science.2665076.
Lancaster et al., Limited trafficking of a neurotropic virus through inefficient retrograde axonal transport and the type I interferon response. PLoS Pathog. Mar. 5, 2010;6(3):e1000791. doi: 10.1371/journal.ppat.1000791.
Langer et al., Chemical and Physical Structure of Polymers as Carriers for Controlled Release of Bioactive Agents: A Review. J Macromol Sci, Part C, 1983;23(1):61-126. doi: 10.1080/07366578308079439.
Lapinaite et al., DNA capture by a CRISPR-Cas9-guided adenine base editor. Science. Jul. 31, 2020;369(6503):566-571. doi: 10.1126/science.abb1390.
Le et al., SMNDelta7, the major product of the centromeric survival motor neuron (SMN2) gene, extends survival in mice with spinal muscular atrophy and associates with full-length SMN. Hum Mol Genet. Mar. 15, 2005;14(6):845-57. doi: 10.1093/hmg/ddi078. Epub Feb. 9, 2005.
Leach et al., Mutations of a mutS homolog in hereditary nonpolyposis colorectal cancer. Cell. Dec. 17, 1993;75(6):1215-25. doi: 10.1016/0092-8674(93)90330-s.
Lee et al., A monoclonal antibody that targets a NaV1.7 channel voltage sensor for pain and itch relief. Cell. Jun. 5, 2014;157(6):1393-

(56) References Cited

OTHER PUBLICATIONS 1404. doi: 10.1016/j.cell.2014.03.064. Epub May 22, 2014. Retraction in: Cell. Jun. 25, 2020;181(7):1695.
Lee et al., Simultaneous targeting of linked loci in mouse embryos using base editing. Sci Rep. Feb. 7, 2019;9(1):1662. doi: 10.1038/s41598-018-33533-5.
Lee et al., Single C-to-T substitution using engineered APOBEC3G-nCas9 base editors with minimum genome- and transcriptome-wide off-target effects. Sci Adv. Jul. 15, 2020;6(29):eaba1773. doi: 10.1126/sciadv.aba1773.
Lee et al., Single C-to-T substitution using engineered APOBEC3G-nCas9 base editors with minimum genome- and transcriptome-wide off-target effects. Sci Adv. Jul. 15, 2020;6(29):eaba1773. doi: 10.1126/sciadv.aba1773. 13 pages.
Lee et al., Targeting fidelity of adenine and cytosine base editors in mouse embryos. Nat Commun. Nov. 15, 2018;9(1):4804. doi: 10.1038/s41467-018-07322-7.
Lefebvre et al., Identification and characterization of a spinal muscular atrophy-determining gene. Cell. Jan. 13, 1995;80(1):155-65. doi: 10.1016/0092-8674(95)90460-3.
Leipold et al., A de novo gain-of-function mutation in SCN11A causes loss of pain perception. Nat Genet. Nov. 2013;45(11):1399-404. doi: 10.1038/ng.2767. Epub Sep. 15, 2013.
Lesinski et al., The potential for targeting the STAT3 pathway as a novel therapy for melanoma. Future Oncol. Jul. 2013;9(7):925-7. doi: 10.2217/fon.13.83. Author Manuscript. 4 pages.
Li et al., Precise Modifications of Both Exogenous and Endogenous Genes in Rice by Prime Editing. Mol Plant. May 4, 2020;13(5):671-674. doi: 10.1016/j.molp.2020.03.011. Epub Mar. 25, 2020.
Li et al., Programmable Single and Multiplex Base-Editing in Bombyx mori Using RNA-Guided Cytidine Deaminases. G3 (Bethesda). May 4, 2018;8(5):1701-1709. doi: 10.1534/g3.118.200134.
Li, Mechanisms and functions of DNA mismatch repair. Cell Res. Jan. 2008;18(1):85-98. doi: 10.1038/cr.2007.115.
Liao et al., One-step assembly of large CRISPR arrays enables multi-functional targeting and reveals constraints on array design. bioRxiv. May 2, 2018. doi: 10.1101/312421. 45 pages.
Liefke et al., The oxidative demethylase ALKBH3 marks hyperactive gene promoters in human cancer cells. Genome Med. Jun. 30, 2015;7(1):66. doi: 10.1186/s13073-015-0180-0.
Lim et al., Viral vectors for neurotrophic factor delivery: a gene therapy approach for neurodegenerative diseases of the CNS. Pharmacol Res. Jan. 2010;61(1):14-26. doi: 10.1016/j.phrs.2009.10.002. Epub Oct. 17, 2009.
Lin et al., [Construction and evaluation of DnaB split intein high expression vector and a six amino acids cyclic peptide library]. Sheng Wu Gong Cheng Xue Bao. Nov. 2008;24(11):1924-30. Chinese.
Lin et al., Base editing-mediated splicing correction therapy for spinal muscular atrophy. Cell Res. Jun. 2020;30(6):548-550. doi: 10.1038/s41422-020-0304-y. Epub Mar. 24, 2020.
Lin et al., High-efficiency prime editing with optimized, paired pegRNAs in plants. Nat Biotechnol. Aug. 2021;39(8):923-927. doi: 10.1038/s41587-021-00868-w. Epub Mar. 25, 2021.
Lin et al., Prime genome editing in rice and wheat. Nat Biotechnol. May 2020;38(5):582-585 and Supplemental Info. doi: 10.1038/s41587-020-0455-x. Epub Mar. 16, 2020. 8 pages.
Lin et al., Prime genome editing in rice and wheat. Nat Biotechnol. May 2020;38(5):582-585. doi: 10.1038/s41587-020-0455-x. Epub Mar. 16, 2020.
Lin et al., The human REV1 gene codes for a DNA template-dependent dCMP transferase. Nucleic Acids Res. Nov. 15, 1999;27(22):4468-75. doi: 10.1093/nar/27.22.4468.
Lindahl, T., Instability and decay of the primary structure of DNA. Nature. Apr. 22, 1993;362(6422):709-15. doi: 10.1038/362709a0.
Liu et al., Computational approaches for effective CRISPR guide RNA design and evaluation. Comput Struct Biotechnol J. Nov. 29, 2019;18:35-44. doi: 10.1016/j.csbj.2019.11.006.

Liu et al., Human BRCA2 protein promotes RAD51 filament formation on RPA-covered single-stranded DNA. Nat Struct Mol Biol. Oct. 2010;17(10):1260-2. doi: 10.1038/nsmb.1904. Epub Aug. 22, 2010.
Liu et al., Improving Editing Efficiency for the Sequences with NGH PAM Using xCas9-Derived Base Editors. Mol Ther Nucleic Acids. Sep. 6, 2019;17:626-635. doi: 10.1016/j.omtn.2019.06.024. Epub Jul. 12, 2019.
Liu et al., Intrinsic Nucleotide Preference of Diversifying Base Editors Guides Antibody Ex Vivo Affinity Maturation. Cell Rep. Oct. 23, 2018;25(4):884-892.e3. doi: 10.1016/j.celrep.2018.09.090.
Liu et al., Usherin is required for maintenance of retinal photoreceptors and normal development of cochlear hair cells. Proc Natl Acad Sci U S A. Mar. 13, 2007;104(11):4413-8. doi: 10.1073/pnas.0610950104. Epub Mar. 5, 2007.
Longsworth, Expanding the Enzymatic Activity of the Programmable Endonuclease Cas9 in Zebrafish. Thesis. Rice University. Houston, TX. May 17, 2019. 41 pages.
Lorson et al., A single nucleotide in the SMN gene regulates splicing and is responsible for spinal muscular atrophy. Proc Natl Acad Sci U S A. May 25, 1999;96(11):6307-11. doi: 10.1073/pnas.96.11.6307.
Lujan et al., Heterogeneous polymerase fidelity and mismatch repair bias genome variation and composition. Genome Res. Nov. 2014;24(11):1751-64. doi: 10.1101/gr.178335.114. Epub Sep. 12, 2014.
Lutz et al., Postsymptomatic restoration of SMN rescues the disease phenotype in a mouse model of severe spinal muscular atrophy. J Clin Invest. Aug. 2011;121(8):3029-41. doi: 10.1172/JCI57291. Epub Jul. 25, 2011.
Lyu et al., Virus-Like Particle Mediated CRISPR/Cas9 Delivery for Efficient and Safe Genome Editing. Life (Basel). Dec. 21, 2020;10(12):366. doi: 10.3390/life10120366.
Ma et al., Human RAD52 interactions with replication protein A and the RAD51 presynaptic complex. J Biol Chem. Jul. 14, 2017;292(28):11702-11713. doi: 10.1074/jbc.M117.794545. Epub May 27, 2017.
Macfadden et al., Mechanism and structural diversity of exoribonuclease-resistant RNA structures in flaviviral RNAs. Nat Commun. Jan. 9, 2018;9(1):119. doi: 10.1038/s41467-017-02604-y.
Madura et al., Structural basis for ineffective T-cell responses to MHC anchor residue-improved "heteroclitic" peptides. Eur J Immunol. Feb. 2015;45(2):584-91. doi: 10.1002/eji.201445114. Epub Dec. 28, 2014.
Maerker et al., A novel Usher protein network at the periciliary reloading point between molecular transport machineries in vertebrate photoreceptor cells. Hum Mol Genet. Jan. 1, 2008;17(1):71-86. doi: 10.1093/hmg/ddm285. Epub Sep. 28, 2007.
Mahoney et al., The Next Immune-Checkpoint Inhibitors: PD-1/PD-L1 Blockade in Melanoma. Clin Ther. Apr. 1, 2015;37(4):764-82. doi: 10.1016/j.clinthera.2015.02.018. Epub Mar. 29, 2015.
Maizels et al., Initiation of homologous recombination at DNA nicks. Nucleic Acids Res. Aug. 21, 2018;46(14):6962-6973. doi: 10.1093/nar/gky588.
Maji et al., A High-Throughput Platform to Identify Small-Molecule Inhibitors of CRISPR-Cas9. Cell. May 2, 2019;177(4):1067-1079.e19. doi: 10.1016/j.cell.2019.04.009.
Mali et al., CAS9 transcriptional activators for target specificity screening and paired nickases for cooperative genome engineering. Nat Biotechnol. Sep. 2013;31(9):833-8, Supplemental Info. doi: 10.1038/nbt.2675. Epub Aug. 1, 2013.
Mangeot et al., Genome editing in primary cells and in vivo using viral-derived Nanoblades loaded with Cas9-sgRNA ribonucleoproteins. Nat Commun. Jan. 3, 2019;10(1):45. doi: 10.1038/s41467-018-07845-z.
Marcovitz et al., Frustration in protein-DNA binding influences conformational switching and target search kinetics. Proc Natl Acad Sci U S A. Nov. 1, 2011;108(44):17957-62. doi: 10.1073/pnas.1109594108. Epub Oct. 14, 2011.
Marsden et al., The Tumor-Associated Variant RAD51 G151D Induces a Hyper-Recombination Phenotype. PLoS Genet. Aug. 11, 2016;12(8):e1006208. doi: 10.1371/journal.pgen.1006208.

(56) References Cited

OTHER PUBLICATIONS

Martz, L., Nav-i-gating antibodies for pain. Science-Business eXchange. Jun. 12, 2014;7(662):1-2. doi: 10.1038/scibx.2014.662.

Marzec et al., Prime Editing: A New Way for Genome Editing. Trends Cell Biol. Apr. 2020;30(4):257-259. doi: 10.1016/j.tcb.2020.01.004. Epub Jan. 27, 2020.

Mason et al., Non-enzymatic roles of human RAD51 at stalled replication forks. bioRxiv. Jul. 31, 2019; doi.org/10.1101/359380. 36 pages. bioRxiv preprint first posted online Jul. 31, 2019.

Mendell et al., Single-Dose Gene-Replacement Therapy for Spinal Muscular Atrophy. N Engl J Med. Nov. 2, 2017;377(18):1713-1722. doi: 10.1056/NEJMoa1706198.

Meyer et al., Ribosome biogenesis factor Tsr3 is the aminocarboxypropyl transferase responsible for 18S rRNA hypermodification in yeast and humans. Nucleic Acids Res. May 19, 2016;44(9):4304-16. doi: 10.1093/nar/gkw244. Epub Apr. 15, 2016.

Micozzi et al., Human cytidine deaminase: a biochemical characterization of its naturally occurring variants. Int J Biol Macromol. Feb. 2014;63:64-74. doi: 10.1016/j.ijbiomac.2013.10.029. Epub Oct. 29, 2013. Erratum in: Int J Biol Macromol. Feb. 2014;63:262.

Miller et al., Continuous evolution of SpCas9 variants compatible with non-G PAMs. Nat Biotechnol. Apr. 2020;38(4):471-481. doi: 10.1038/s41587-020-0412-8. Epub Feb. 10, 2020.

Miller et al., Phage-assisted continuous and non-continuous evolution. Nat Protoc. Dec. 2020;15(12):4101-4127. doi: 10.1038/s41596-020-00410-3. Epub Nov. 16, 2020.

Millevoi et al., G-quadruplexes in RNA biology. Wiley Interdiscip Rev RNA. Jul.-Aug. 2012;3(4):495-507. doi: 10.1002/wrna.1113. Epub Apr. 4, 2012.

Min et al., Deep learning in bioinformatics. Brief Bioinform. Sep. 1, 2017;18(5):851-869. doi: 10.1093/bib/bbw068.

Mir et al., Type II-C CRISPR-Cas9 Biology, Mechanism, and Application. ACS Chem Biol. Feb. 16, 2018;13(2):357-365. doi: 10.1021/acschembio.7b00855. Epub Dec. 20, 2017.

Monani et al., A single nucleotide difference that alters splicing patterns distinguishes the SMA gene SMN1 from the copy gene SMN2. Hum Mol Genet. Jul. 1999;8(7):1177-83. doi: 10.1093/hmg/8.7.1177.

Mootz et al., Protein splicing triggered by a small molecule. J Am Chem Soc. Aug. 7, 2002;124(31):9044-5 and Supporting Information. doi: 10.1021/ja0267690. 4 pages.

Moreno-Mateos et al., CRISPRscan: designing highly efficient sgRNAs for CRISPR-Cas9 targeting in vivo. Nat Methods. Oct. 2015;12(10):982-8. doi: 10.1038/nmeth.3543. Epub Aug. 31, 2015.

Mougiakos et al., Characterizing a thermostable Cas9 for bacterial genome editing and silencing. Nat Commun. Nov. 21, 2017;8(1):1647. doi: 10.1038/s41467-017-01591-4.

Muller, U.F., Design and Experimental Evolution of trans-Splicing Group I Intron Ribozymes. Molecules. Jan. 2, 2017;22(1):75. doi: 10.3390/molecules22010075.

Murphy, Phage recombinases and their applications. Adv Virus Res. 2012;83:367-414. doi: 10.1016/B978-0-12-394438-2.00008-6. Review.

Murray et al., Selective vulnerability of motor neurons and dissociation of pre- and post-synaptic pathology at the neuromuscular junction in mouse models of spinal muscular atrophy. Hum Mol Genet. Apr. 1, 2008;17(7):949-62. doi: 10.1093/hmg/ddm367. Epub Dec. 8, 2007.

Murugan et al., The Revolution Continues: Newly Discovered Systems Expand the CRISPR-Cas Toolkit. Mol Cell. Oct. 5, 2017;68(1):15-25. doi: 10.1016/j.molcel.2017.09.007.

Nelson et al., In vivo genome editing improves muscle function in a mouse model of Duchenne muscular dystrophy. Science. Jan. 22, 2016;351(6271):403-7. doi: 10.1126/science.aad5143. Epub Dec. 31, 2015.

Nelson et al., The unstable repeats—three evolving faces of neurological disease. Neuron. Mar. 6, 2013;77(5):825-43. doi: 10.1016/j.neuron.2013.02.022.

Nguyen Tran et al., Engineering domain-inlaid SaCas9 adenine base editors with reduced RNA off-targets and increased on-target DNA editing. Nat Commun. Sep. 25, 2020;11(1):4871. doi: 10.1038/s41467-020-18715-y.

Niemeyer, C.M., Semisynthetic DNA-protein conjugates for biosensing and nanofabrication. Angew Chem Int Ed Engl. Feb. 8, 2010;49(7):1200-16. doi: 10.1002/anie.200904930.

Noack et al., Epitranscriptomics: A New Regulatory Mechanism of Brain Development and Function. Front Neurosci. Feb. 20, 2018;12:85. doi: 10.3389/fnins.2018.00085. 9 pages.

Olorunniji et al., Synapsis and catalysis by activated Tn3 resolvase mutants. Nucleic Acids Res. Dec. 2008;36(22):7181-91. doi: 10.1093/nar/gkn885. Epub Nov. 10, 2008.

Osborn et al., Base Editor Correction of COL7A1 in Recessive Dystrophic Epidermolysis Bullosa Patient-Derived Fibroblasts and iPSCs. J Invest Dermatol. Feb. 2020;140(2):338-347.e5. doi: 10.1016/j.jid.2019.07.701. Epub Aug. 19, 2019.

Ottesen, ISS-N1 makes the First FDA-approved Drug for Spinal Muscular Atrophy. Transl Neurosci. Jan. 26, 2017;8:1-6. doi: 10.1515/tnsci-2017-0001.

Ousterout et al., Multiplex CRISPR/Cas9-based genome editing for correction of dystrophin mutations that cause Duchenne muscular dystrophy. Nat Commun. Feb. 18, 2015;6:6244. doi: 10.1038/ncomms7244.

Packer et al., Methods for the directed evolution of proteins. Nat Rev Genet. Jul. 2015;16(7):379-94. doi: 10.1038/nrg3927. Epub Jun. 9, 2015.

Packer et al., Phage-assisted continuous evolution of proteases with altered substrate specificity. Nat Commun. Oct. 16, 2017;8(1):956. doi: 10.1038/s41467-017-01055-9.

Pandey et al., Effect of loops and G-quartets on the stability of RNA G-quadruplexes. J Phys Chem B. Jun. 13, 2013;117(23):6896-905. doi: 10.1021/jp401739m. Epub May 29, 2013. Supplementary Information, 21 pages.

Parente et al., Advances in spinal muscular atrophy therapeutics. Ther Adv Neurol Disord. Feb. 5, 2018;11:1756285618754501. doi: 10.1177/1756285618754501. 13 pages.

Parsons et al., Hypermutability and mismatch repair deficiency in RER+ tumor cells. Cell. Dec. 17, 1993;75(6):1227-36. doi: 10.1016/0092-8674(93)90331-j.

Passini et al., Antisense oligonucleotides delivered to the mouse CNS ameliorate symptoms of severe spinal muscular atrophy. Sci Transl Med. Mar. 2, 2011;3(72):72ra18. doi: 10.1126/scitranslmed.3001777.

Pellegrini et al., Insights into DNA recombination from the structure of a RAD51-BRCA2 complex. Nature. Nov. 21, 2002;420(6913):287-93. doi: 10.1038/nature01230. Epub Nov. 10, 2002.

Pendse et al., Exon 13-skipped USH2A protein retains functional integrity in mice, suggesting an exo-skipping therapeutic approach to treat USH2A-associated disease. bioRxiv preprint. Feb. 4, 2020. Retrieved from www.biorxiv.org. doi: 10.1101/2020.02.04.934240. 34 pages.

Pendse et al., In Vivo Assessment of Potential Therapeutic Approaches for USH2A-Associated Diseases. Adv Exp Med Biol. 2019;1185:91-96. doi: 10.1007/978-3-030-27378-1_15.

Perez-Palma et al., Simple ClinVar: an interactive web server to explore and retrieve gene and disease variants aggregated in ClinVar database. Nucleic Acids Res. Jul. 2, 2019;47(W1):W99-W105. doi: 10.1093/nar/gkz411.

Perreault et al., Mixed deoxyribo- and ribo-oligonucleotides with catalytic activity. Nature. Apr. 5, 1990;344(6266):565-7. doi: 10.1038/344565a0.

Petit et al., Powerful mutators lurking in the genome. Philos Trans R Soc Lond B Biol Sci. Mar. 12, 2009;364(1517):705-15. doi: 10.1098/rstb.2008.0272.

Petri et al., CRISPR prime editing with ribonucleoprotein complexes in zebrafish and primary human cells. Nat Biotechnol. Feb. 2022;40(2):189-193. doi: 10.1038/s41587-021-00901-y. Epub Apr. 29, 2021. Erratum in: Nat Biotechnol. May 13, 2021.

Pieken et al., Kinetic characterization of ribonuclease-resistant 2'-modified hammerhead ribozymes. Science. Jul. 19, 1991;253(5017):314-7. doi: 10.1126/science.1857967.

(56) References Cited

OTHER PUBLICATIONS

Pijlman et al., A highly structured, nuclease-resistant, noncoding RNA produced by flaviviruses is required for pathogenicity. Cell Host Microbe. Dec. 11, 2008;4(6):579-91. doi: 10.1016/j.chom.2008.10.007.

Piotukh et al., Directed evolution of sortase A mutants with altered substrate selectivity profiles. J Am Chem Soc. Nov. 9, 2011;133(44):17536-9. doi: 10.1021/ja205630g. Epub Oct. 13, 2011.

Plotz et al., N-terminus of hMLH1 confers interaction of hMutLalpha and hMutLbeta with hMutSalpha. Nucleic Acids Res. Jun. 15, 2003;31(12):3217-26. doi: 10.1093/nar/gkg420.

Podracky et al., Laboratory evolution of a sortase enzyme that modifies amyloid-β protein. Nat Chem Biol. Mar. 2021;17(3):317-325. doi: 10.1038/s41589-020-00706-1. Epub Jan. 11, 2021.

Porensky et al., A single administration of morpholino antisense oligomer rescues spinal muscular atrophy in mouse. Hum Mol Genet. Apr. 1, 2012;21(7):1625-38. doi: 10.1093/hmg/ddr600. Epub Dec. 20, 2011.

Prasad et al., Rev1 is a base excision repair enzyme with 5'-deoxyribose phosphate lyase activity. Nucleic Acids Res. Dec. 15, 2016;44(22):10824-10833. doi: 10.1093/nar/gkw869. Epub Sep. 28, 2016.

Prasad et al., Visualizing the assembly of human Rad51 filaments on double-stranded DNA. J Mol Biol. Oct. 27, 2006;363(3):713-28. doi: 10.1016/j.jmb.2006.08.046. Epub Aug. 22, 2006.

Raghavan et al., Abstract 27: Therapeutic Targeting of Human Lipid Genes with in vivo CRISPR-Cas9 Genome Editing. Oral Abstract Presentations: Lipoprotein Metabolism and Therapeutic Targets. Arterioscler THromb Vasc Biol. 2015;35(Suppl. 1):Abstract 27. 5 pages.

Raillard et al., Targeting sites within HIV-1 cDNA with a DNA-cleaving ribozyme. Biochemistry. Sep. 10, 1996;35(36):11693-701. doi: 10.1021/bi960845g.

Rajagopal et al., High-throughput mapping of regulatory DNA. Nat Biotechnol. Feb. 2016;34(2):167-74. doi: 10.1038/nbt.3468. Epub Jan. 25, 2016.

Ramos et al., Age-dependent SMN expression in disease-relevant tissue and implications for SMA treatment. J Clin Invest. Nov. 1, 2019;129(11):4817-4831. doi: 10.1172/JCI124120.

Räschle et al., Mutations within the hMLH1 and hPMS2 subunits of the human MutLalpha mismatch repair factor affect its ATPase activity, but not its ability to interact with hMutSalpha. J Biol Chem. Jun. 14, 2002;277(24):21810-20. doi: 10.1074/jbc.M108787200. Epub Apr. 10, 2002.

Reiners et al., Scaffold protein harmonin (USH1C) provides molecular links between Usher syndrome type 1 and type 2. Hum Mol Genet. Dec. 15, 2005;14(24):3933-43. doi: 10.1093/hmg/ddi417. Epub Nov. 21, 2005.

Richardson et al., CRISPR-Cas9 genome editing in human cells occurs via the Fanconi anemia pathway. Nat Genet. Aug. 2018;50(8):1132-1139. doi: 10.1038/s41588-018-0174-0. Epub Jul. 27, 2018.

Richardson et al., Frequent chromosomal translocations induced by DNA double-strand breaks. Nature. Jun. 8, 2000;405(6787):697-700. doi: 10.1038/35015097.

Robert et al., Virus-Like Particles Derived from HIV-1 for Delivery of Nuclear Proteins: Improvement of Production and Activity by Protein Engineering. Mol Biotechnol. Jan. 2017;59(1):9-23. doi: 10.1007/s12033-016-9987-1.

Robertson et al., Selection in vitro of an RNA enzyme that specifically cleaves single-stranded DNA. Nature. Mar. 29, 1990;344(6265):467-8. doi: 10.1038/344467a0.

Rodriguez-Muela et al., Single-Cell Analysis of SMN Reveals Its Broader Role in Neuromuscular Disease. Cell Rep. Feb. 7, 2017;18(6):1484-1498 and Supplemental Information. doi: 10.1016/j.celrep.2017.01.035.

Rongrong et al., Effect of deletion mutation on the recombination activity of Cre recombinase. Acta Biochim Pol. 2005;52(2):541-4. Epub May 15, 2005.

Rowley, Chromosome translocations: dangerous liaisons revisited. Nat Rev Cancer. Dec. 2001;1(3):245-50. doi: 10.1038/35106108.

Saayman et al., The therapeutic application of CRISPR/Cas9 technologies for HIV. Expert Opin Biol Ther. Jun. 2015;15(6):819-30. doi: 10.1517/14712598.2015.1036736. Epub Apr. 12, 2015.

Sadowski, The Flp recombinase of the 2-microns plasmid of *Saccharomyces cerevisiae*. Prog Nucleic Acid Res Mol Biol. 1995;51:53-91.

Safari et al., CRISPR Cpf1 proteins: structure, function and implications for genome editing. Cell Biosci. May 9, 2019;9:36. doi: 10.1186/s13578-019-0298-7.

Saha et al., The NIH Somatic Cell Genome Editing program. Nature. Apr. 2021;592(7853):195-204. doi: 10.1038/s41586-021-03191-1. Epub Apr. 7, 2021.

Sale et al., Y-family DNA polymerases and their role in tolerance of cellular DNA damage. Nat Rev Mol Cell Biol. Feb. 23, 2012;13(3):141-52. doi: 10.1038/nrm3289.

Samanta et al., A reverse transcriptase ribozyme. Elife. Sep. 26, 2017;6:e31153. doi: 10.7554/eLife.31153.

San Filippo et al., Mechanism of eukaryotic homologous recombination. Annu Rev Biochem. 2008;77:229-57. doi: 10.1146/annurev.biochem.77.061306.125255.

Sang et al., A unique uracil-DNA binding protein of the uracil DNA glycosylase superfamily. Nucleic Acids Res. Sep. 30, 2015;43(17):8452-63. doi: 10.1093/nar/gkv854. Epub Aug. 24, 2015.

Sanjurjo-Soriano et al., Genome Editing in Patient iPSCs Corrects the Most Prevalent USH2A Mutations and Reveals Intriguing Mutant mRNA Expression Profiles. Mol Ther Methods Clin Dev. Nov. 27, 2019;17:156-173. doi: 10.1016/j.omtm.2019.11.016.

Sapunar et al., Dorsal root ganglion—a potential new therapeutic target for neuropathic pain. J Pain Res. 2012;5:31-8. doi: 10.2147/JPR.S26603. Epub Feb. 16, 2012.

Savva et al., The structural basis of specific base-excision repair by uracil-DNA glycosylase. Nature. Feb. 9, 1995;373(6514):487-93. doi: 10.1038/373487a0.

Schlacher et al., Double-strand break repair-independent role for BRCA2 in blocking stalled replication fork degradation by MRE11. Cell. May 13, 2011;145(4):529-42. doi: 10.1016/j.cell.2011.03.041. Erratum in: Cell. Jun. 10, 2011;145(6):993.

Schrank et al., Inactivation of the survival motor neuron gene, a candidate gene for human spinal muscular atrophy, leads to massive cell death in early mouse embryos. Proc Natl Acad Sci U S A. Sep. 2, 1997;94(18):9920-5. doi: 10.1073/pnas.94.18.9920.

Score Results for Luetticken et al., Complete genome sequence of a *Streptococcus dysgalactiae* subsp. RT equisimilis strain possessing Lancefield's group A antigen. RL Submitted to the EMBL/GenBank/DDBJ databases. May 2012. 3 pages.

Score Results for Okumura et al., Evolutionary paths of streptococcal and staphylococcal superantigens. RL BMC Genomics. 2012;13:404-404. 3 pages.

Score Results for Shimomura et al., Complete Genome Sequencing and Analysis of a Lancefield Group G RT *Streptococcus dysagalactiae* Subsp. Equisimilis Strain Causing Streptococcal RT Toxic Shock Syndrome (STSS). RL BMC Genomics. 2011;12:17-17. 3 pages.

Shaikh et al., Chimeras of the Flp and Cre recombinases: tests of the mode of cleavage by Flp and Cre. J Mol Biol. Sep. 8, 2000;302(1):27-48.

Sharma et al., Identification of novel methyltransferases, Bmt5 and Bmt6, responsible for the m3U methylations of 25S rRNA in *Saccharomyces cerevisiae*. Nucleic Acids Res. Mar. 2014;42(5):3246-60. doi: 10.1093/nar/gkt1281. Epub Dec. 11, 2013.

Shcherbakova et al., Mutator phenotypes conferred by MLH1 overexpression and by heterozygosity for mlh1 mutations. Mol Cell Biol. Apr. 1999;19(4):3177-83. doi: 10.1128/MCB.19.4.3177.

Shechner et al., Multiplexable, locus-specific targeting of long RNAs with CRISPR-Display. Nat Methods. Jul. 2015;12(7):664-70. doi: 10.1038/nmeth.3433. Epub Jun. 1, 2015.

Shen et al., Efficient genome modification by CRISPR-Cas9 nickase with minimal off-target effects. Nat Methods. Apr. 2014;11(4):399-402. doi: 10.1038/nmeth.2857. Epub Mar. 2, 2014.

Shen et al., Herpes simplex virus 1 (HSV-1) for cancer treatment. Cancer Gene Ther. Nov. 2006;13(11):975-92. doi: 10.1038/sj.cgt.7700946. Epub Apr. 7, 2006.

(56) References Cited

OTHER PUBLICATIONS

Singh et al., Real-time observation of DNA target interrogation and product release by the RNA-guided endonuclease CRISPR Cpf1 (Cas12a). Proc Natl Acad Sci U S A. May 22, 2018;115(21):5444-5449. doi: 10.1073/pnas.1718686115. Epub May 7, 2018.
Singh et al., Splicing of a critical exon of human Survival Motor Neuron is regulated by a unique silencer element located in the last intron. Mol Cell Biol. Feb. 2006;26(4):1333-46. doi: 10.1128/MCB.26.4.1333-1346.2006.
Siu et al., Riboregulated toehold-gated gRNA for programmable CRISPR-Cas9 function. Nat Chem Biol. Mar. 2019;15(3):217-220. doi: 10.1038/s41589-018-0186-1. Epub Dec. 10, 2018.
Slupphaug et al., A nucleotide-flipping mechanism from the structure of human uracil-DNA glycosylase bound to DNA. Nature. Nov. 7, 1996;384(6604):87-92. doi: 10.1038/384087a0.
Smith et al., Diversity in the serine recombinases. Mol Microbiol. Apr. 2002;44(2):299-307. Review.
Smith et al., Herpesvirus transport to the nervous system and back again. Annu Rev Microbiol. 2012;66:153-76. doi: 10.1146/annurev-micro-092611-150051. Epub Jun. 15, 2012.
Somanathan et al., AAV vectors expressing LDLR gain-of-function variants demonstrate increased efficacy in mouse models of familial hypercholesterolemia. Circ Res. Aug. 29, 2014;115(6):591-9. doi: 10.1161/CIRCRESAHA.115.304008. Epub Jul. 14, 2014.
Song et al., Adenine base editing in an adult mouse model of tyrosinaemia. Nat Biomed Eng. Jan. 2020;4(1):125-130. doi: 10.1038/s41551-019-0357-8. Epub Feb. 25, 2019.
Song et al., Delivery of CRISPR/Cas systems for cancer gene therapy and immunotherapy. Adv Drug Deliv Rev. Jan. 2021;168:158-180. doi: 10.1016/j.addr.2020.04.010. Epub May 1, 2020.
Song et al., RS-1 enhances CRISPR/Cas9- and TALEN-mediated knock-in efficiency. Nat Commun. Jan. 28, 2016;7:10548. doi: 10.1038/ncomms10548.
Sorusch et al., Characterization of the ternary Usher syndrome SANS/ush2a/whirlin protein complex. Hum Mol Genet. Mar. 15, 2017;26(6):1157-1172. doi: 10.1093/hmg/ddx027.
Stark et al., ATP hydrolysis by mammalian RAD51 has a key role during homology-directed DNA repair. J Biol Chem. Jun. 7, 2002;277(23):20185-94. doi: 10.1074/jbc.M112132200. Epub Mar. 28, 2002.
Steckelberg et al., A folded viral noncoding RNA blocks host cell exoribonucleases through a conformationally dynamic RNA structure. Proc Natl Acad Sci U S A. Jun. 19, 2018;115(25):6404-6409. doi: 10.1073/pnas.1802429115. Epub Jun. 4, 2018.
Steiner et al., The neurotropic herpes viruses: herpes simplex and varicella-zoster. Lancet Neurol. Nov. 2007;6(11):1015-28. doi: 10.1016/S1474-4422(07)70267-3.
Strand et al., Destabilization of tracts of simple repetitive DNA in yeast by mutations affecting DNA mismatch repair. Nature. Sep. 16, 1993;365(6443):274-6. doi: 10.1038/365274a0. Erratum in: Nature Apr. 7, 1994;368(6471);569.
Strecker et al., Engineering of CRISPR-Cas12b for human genome editing. Nat Commun. Jan. 22, 2019;10(1):212. doi: 10.1038/s41467-018-08224-4.
Su et al., Mispair specificity of methyl-directed DNA mismatch correction in vitro. J Biol Chem. May 15, 1988;263(14):6829-35. Erratum in: J Biol Chem Aug. 5, 1988;263(22):11015.
Sudarsan et al., Riboswitches in eubacteria sense the second messenger cyclic di-GMP. Science. Jul. 18, 2008;321(5887):411-3. doi: 10.1126/science.1159519.
Sugawara et al., Heteroduplex rejection during single-strand annealing requires Sgs1 helicase and mismatch repair proteins Msh2 and Msh6 but not Pms1. Proc Natl Acad Sci U S A. Jun. 22, 2004;101(25):9315-20. doi: 10.1073/pnas.0305749101. Epub Jun. 15, 2004.
Suh et al., Restoration of visual function in adult mice with an inherited retinal disease via adenine base editing. Nat Biomed Eng. Feb. 2021;5(2):169-178. doi: 10.1038/s41551-020-00632-6. Epub Oct. 19, 2020.
Sullenger et al., Ribozyme-mediated repair of defective mRNA by targeted, trans-splicing. Nature. Oct. 13, 1994;371(6498):619-22. doi: 10.1038/371619a0.
Sumner et al., Two breakthrough gene-targeted treatments for spinal muscular atrophy: challenges remain. J Clin Invest. Aug. 1, 2018;128(8):3219-3227. doi: 10.1172/JCI121658. Epub Jul. 9, 2018.
Supek et al., Differential DNA mismatch repair underlies mutation rate variation across the human genome. Nature. May 7, 2015;521(7550):81-4. doi: 10.1038/nature14173. Epub Feb. 23, 2015.
Suzuki et al., Crystal structures reveal an elusive functional domain of pyrrolysyl-tRNA synthetase. Nat Chem Biol. Dec. 2017;13(12):1261-1266. doi: 10.1038/nchembio.2497. Epub Oct. 16, 2017.
Svitashev et al., Targeted Mutagenesis, Precise Gene Editing, and Site-Specific Gene Insertion in Maize Using Cas9 and Guide RNA. Plant Physiol. Oct. 2015;169(2):931-45. doi: 10.1104/pp.15.00793. Epub Aug. 12, 2015.
Talbot et al., Spinal muscular atrophy. Semin Neurol. Jun. 2001;21(2):189-97. doi: 10.1055/s-2001-15264.
Tan et al., Engineering of high-precision base editors for site-specific single nucleotide replacement. Nat Commun. Jan. 25, 2019;10(1):439. doi: 10.1038/s41467-018-08034-8. Erratum in: Nat Commun. May 1, 2019;10(1):2019.
Teng et al., Mutational analysis of apolipoprotein B mRNA editing enzyme (APOBEC1). structure-function relationships of RNA editing and dimerization. J Lipid Res. Apr. 1999;40(4):623-35.
Thomas et al., Heteroduplex repair in extracts of human HeLa cells. J Biol Chem. Feb. 25, 1991;266(6):3744-51.
Thompson et al., The Future of Multiplexed Eukaryotic Genome Engineering. ACS Chem Biol. Feb. 16, 2018;13(2):313-325. doi: 10.1021/acschembio.7b00842. Epub Dec. 28, 2017.
Tomer et al., Contribution of human mlh1 and pms2 ATPase activities to DNA mismatch repair. J Biol Chem. Jun. 14, 2002;277(24):21801-9. doi: 10.1074/jbc.M111342200. Epub Mar. 15, 2002.
Tran et al., Hypermutability of homonucleotide runs in mismatch repair and DNA polymerase proofreading yeast mutants. Mol Cell Biol. May 1997;17(5):2859-65. doi: 10.1128/MCB.17.5.2859.
Trojan et al., Functional analysis of hMLH1 variants and HNPCC-related mutations using a human expression system. Gastroenterology. Jan. 2002;122(1):211-9. doi: 10.1053/gast.2002.30296.
Umar et al., DNA loop repair by human cell extracts. Science. Nov. 4, 1994;266(5186):814-6. doi: 10.1126/science.7973637.
Uniprot Consortium, UniProt: the universal protein knowledgebase. Nucleic Acids Res. Mar. 16, 2018;46(5):2699. doi: 10.1093/nar/gky092. Erratum for: Nucleic Acids Res. Jan. 4, 2017;45(D1):D158-D169.
Usman et al., Exploiting the chemical synthesis of RNA. Trends Biochem Sci. Sep. 1992;17(9):334-9. doi: 10.1016/0968-0004(92)90306-t.
Vakulskas et al., A high-fidelity Cas9 mutant delivered as a ribonucleoprotein complex enables efficient gene editing in human hematopoietic stem and progenitor cells. Nat Med. Aug. 2018;24(8):1216-1224. doi: 10.1038/s41591-018-0137-0. Epub Aug. 6, 2018.
Van Den Oord et al., Pixel Recurrent Neural Networks. Proceedings of the 33rd International Conference on Machine Learning. Journal of Machine Learning Research. Aug. 19, 2016. vol. 48. 11 pages.
Van Wijk et al., Identification of 51 novel exons of the Usher syndrome type 2A (USH2A) gene that encode multiple conserved functional domains and that are mutated in patients with Usher syndrome type II. Am J Hum Genet. Apr. 2004;74(4):738-44. doi: 10.1086/383096. Epub Mar. 10, 2004.
Varshney et al., The regulation and functions of DNA and RNA G-quadruplexes. Nat Rev Mol Cell Biol. Aug. 2020;21(8):459-474. doi: 10.1038/s41580-020-0236-x. Epub Apr. 20, 2020.
Venken et al., Genome-wide manipulations of *Drosophila melanogaster* with transposons, Flp recombinase, and ΦC31 integrase. Methods Mol Biol. 2012;859:203-28. doi: 10.1007/978-1-61779-603-6_12.
Vidal et al., Yeast forward and reverse 'n'-hybrid systems. Nucleic Acids Res. Feb. 15, 1999;27(4):919-29. doi: 10.1093/nar/27.4.919.

(56) References Cited

OTHER PUBLICATIONS

Villiger et al., Treatment of a metabolic liver disease by in vivo genome base editing in adult mice. Nat Med. Oct. 2018;24(10):1519-1525. doi: 10.1038/s41591-018-0209-1. Epub Oct. 8, 2018.

Vriend et al., Nick-initiated homologous recombination: Protecting the genome, one strand at a time. DNA Repair (Amst). Feb. 2017;50:1-13. doi: 10.1016/j.dnarep.2016.12.005. Epub Dec. 29, 2016.

Walton et al., Unconstrained genome targeting with near-PAMless engineered CRISPR-Cas9 variants. Science. Apr. 17, 2020;368(6488):290-296. doi: 10.1126/science.aba8853. Epub Mar. 26, 2020.

Wan et al., Material solutions for delivery of CRISPR/Cas-based genome editing tools: Current status and future outlook. Materials Today. Jun. 2019;26:40-66. doi: 10.1016/j.mattod.2018.12.003.

Wang et al., Optimized paired-sgRNA/Cas9 cloning and expression cassette triggers high-efficiency multiplex genome editing in kiwifruit. Plant Biotechnol J. Aug. 2018;16(8):1424-1433. doi: 10.1111/pbi.12884. Epub Feb. 6, 2018.

Wang et al., *Staphylococcus aureus* protein SAUGI acts as a uracil-DNA glycosylase inhibitor. Nucleic Acids Res. Jan. 2014;42(2):1354-64. doi: 10.1093/nar/gkt964. Epub Oct. 22, 2013.

Warren et al., Structure of the human MutSalpha DNA lesion recognition complex. Mol Cell. May 25, 2007;26(4):579-92. doi: 10.1016/j.molcel.2007.04.018.

Weill et al., DNA polymerases in adaptive immunity. Nat Rev Immunol. Apr. 2008;8(4):302-12. doi: 10.1038/nri2281. Epub Mar. 14, 2008.

Weiss et al., Loss-of-function mutations in sodium channel Nav1.7 cause anosmia. Nature. Apr. 14, 2011;472(7342):186-90. doi: 10.1038/nature09975. Epub Mar. 23, 2011.

Wills et al., Pseudoknot-dependent read-through of retroviral gag termination codons: importance of sequences in the spacer and loop 2. EMBO J. Sep. 1, 1994;13(17):4137-44. doi: 10.1002/j.1460-2075.1994.tb06731.x.

Wilson et al., Programmable m6A modification of cellular RNAs with a Cas13-directed methyltransferase. Nat Biotechnol. Dec. 2020;38(12):1431-1440. doi: 10.1038/s41587-020-0572-6. Epub Jun. 29, 2020.

Wirth et al., Mildly affected patients with spinal muscular atrophy are partially protected by an increased SMN2 copy number. Hum Genet. May 2006;119(4):422-8. doi: 10.1007/s00439-006-0156-7. Epub Mar. 1, 2006.

Woo et al., Gene activation of SMN by selective disruption of lncRNA-mediated recruitment of PRC2 for the treatment of spinal muscular atrophy. Proc Natl Acad Sci U S A. Feb. 21, 2017;114(8):E1509-E1518. doi:10.1073/pnas.1616521114. Epub Feb. 13, 2017.

Woods et al., The phenotype of congenital insensitivity to pain due to the NaV1.9 variant p.L811P. Eur J Hum Genet. May 2015;23(5):561-3. doi: 10.1038/ejhg.2014.166. Epub Aug. 13, 2014.

Wu et al., A novel SCN9A mutation responsible for primary erythromelalgia and is resistant to the treatment of sodium channel blockers. PLoS One. 2013;8(1):e55212. doi: 10.1371/journal.pone.0055212. Epub Jan. 31, 2013. 15 pages.

Wu et al., MLV based viral-like-particles for delivery of toxic proteins and nuclear transcription factors. Biomaterials. Sep. 2014;35(29):8416-26. doi: 10.1016/j.biomaterials.2014.06.006. Epub Jul. 3, 2014.

Wu et al., Widespread Influence of 3'-End Structures on Mammalian mRNA Processing and Stability. Cell. May 18, 2017;169(5):905-917.e11. doi: 10.1016/j.cell.2017.04.036.

Xi et al., C-terminal Loop Mutations Determine Folding and Secretion Properties of PCSK9. Biochem Mol Biol J. 2016;2(3):17. doi: 10.21767/2471-8084.100026. 12 pages.

Xu et al., Multiplex nucleotide editing by high-fidelity Cas9 variants with improved efficiency in rice. BMC Plant Biol. 2019;19(1):511. Published Nov. 21, 2019. doi:10.1186/s12870-019-2131-1. Includes supplementary data and materials.

Yamada et al., Crystal Structure of the Minimal Cas9 from Campylobacter jejuni Reveals the Molecular Diversity in the CRISPR-Cas9 Systems. Mol Cell. Mar. 16, 2017;65(6):P1109-1121. /doi.org/10.1016/j.molcel.2017.02.007.

Yamane et al., Deep-sequencing identification of the genomic targets of the cytidine deaminase AID and its cofactor RPA in B lymphocytes. Nat Immunol. Jan. 2011;12(1):62-9. doi: 10.1038/ni.1964. Epub Nov. 28, 2010.

Yan et al., Functionally diverse type V CRISPR-Cas systems. Science. Jan. 4, 2019;363(6422):88-91. doi: 10.1126/science.aav7271. Epub Dec. 6, 2018.

Yan et al., Highly Efficient A•T to G•C Base Editing by Cas9n-Guided tRNA Adenosine Deaminase in Rice. Mol Plant. Apr. 2, 2018;11(4):631-634. doi: 10.1016/j.molp.2018.02.008. Epub Feb. 22, 2018.

Yang et al., A Tale of Two Moieties: Rapidly Evolving CRISPR/Cas-Based Genome Editing. Trends Biochem Sci. Oct. 2020;45(10):874-888. doi: 10.1016/j.tibs.2020.06.003. Epub Jun. 30, 2020.

Yang et al., BRCA2 function in DNA binding and recombination from a BRCA2-DSS1-ssDNA structure. Science. Sep. 13, 2002;297(5588):1837-48. doi: 10.1126/science.297.5588.1837.

Yang et al., Genome-wide inactivation of porcine endogenous retroviruses (PERVs). Science. Nov. 27, 2015;350(6264):1101-4. doi: 10.1126/science.aad1191. Epub Oct. 11, 2015.

Yang et al., Mutations in SCN9A, encoding a sodium channel alpha subunit, in patients with primary erythermalgia. J Med Genet. Mar. 2004;41(3):171-4. doi: 10.1136/jmg.2003.012153.

Yang et al., One Prime for All Editing. Cell. Dec. 12, 2019;179(7):1448-1450. doi: 10.1016/j.cell.2019.11.030.

Yang et al., The BRCA2 homologue Brh2 nucleates RAD51 filament formation at a dsDNA-ssDNA junction. Nature. Feb. 10, 2005;433(7026):653-7. doi: 10.1038/nature03234.

Yang, Development of Human Genome Editing Tools for the Study of Genetic Variations and Gene Therapies. Doctoral Dissertation. Harvard University. 2013. Accessible via nrs.harvard.edu/urn-3:HUL.InstRepos:11181072. 277 pages.

Yang, Nucleases: diversity of structure, function and mechanism. Q Rev Biophys. Feb. 2011;44(1):1-93. doi: 10.1017/S0033583510000181. Epub Sep. 21, 2010.

Yasui, Alternative excision repair pathways. Cold Spring Harb Perspect Biol. Jun. 1, 2013;5(6):a012617. doi: 10.1101/cshperspect.a012617.

Yeh et al., In vivo base editing of post-mitotic sensory cells. Nat Commun. Jun. 5, 2018;9(1):2184. doi: 10.1038/s41467-018-04580-3.

Yeh et al., In vivo base editing restores sensory transduction and transiently improves auditory function in a mouse model of recessive deafness. Sci Transl Med. Jun. 3, 2020;12(546):eaay9101. doi: 10.1126/scitranslmed.aay9101.

Yi et al., Engineering of TEV protease variants by yeast ER sequestration screening (YESS) of combinatorial libraries. Proc Natl Acad Sci U S A. Apr. 30, 2013;110(18):7229-34. doi: 10.1073/pnas.1215994110. Epub Apr. 15, 2013.

Yu et al., Cytosine base editors with minimized unguided DNA and RNA off-target events and high on-target activity. Nat Commun. Apr. 28, 2020;11(1):2052. doi: 10.1038/s41467-020-15887-5.

Yu et al., Dynamic control of Rad51 recombinase by self-association and interaction with BRCA2. Mol Cell. Oct. 2003;12(4):1029-41. doi: 10.1016/s1097-2765(03)00394-0.

Zeng et al., Correction of the Marfan Syndrome Pathogenic FBN1 Mutation by Base Editing in Human Cells and Heterozygous Embryos. Mol Ther. Nov. 7, 2018;26(11):2631-2637. doi: 10.1016/j.ymthe.2018.08.007. Epub Aug. 14, 2018.

Zhang et al., Efficient precise knockin with a double cut HDR donor after CRISPR/Cas9-mediated double-stranded DNA cleavage. Genome Biol. Feb. 20, 2017;18(1):35. doi: 10.1186/s13059-017-1164-8.

Zhang et al., Global analysis of small RNA and mRNA targets of Hfq. Mol Microbiol. Nov. 2003;50(4):1111-24. doi: 10.1046/j.1365-2958.2003.03734.x.

Zhang et al., Large genomic fragment deletions and insertions in mouse using CRISPR/Cas9. PLoS One. Mar. 24, 2015;10(3):e0120396. doi: 10.1371/journal.pone.0120396. 14 pages.

(56) References Cited

OTHER PUBLICATIONS

Zhang et al., Reconstitution of 5'-directed human mismatch repair in a purified system. Cell. Sep. 9, 2005;122(5):693-705. doi: 10.1016/j.cell.2005.06.027.

Zhang et al., Reversible RNA Modification N1-methyladenosine (m1A) in mRNA and tRNA. Genomics Proteomics Bioinformatics. Jun. 2018;16(3):155-161. doi: 10.1016/j.gpb.2018.03.003. Epub Jun. 14, 2018.

Zhao et al., An ultraprocessive, accurate reverse transcriptase encoded by a metazoan group II intron. RNA. Feb. 2018;24(2):183-195. doi: 10.1261/rna.063479.117. Epub Nov. 6, 2017.

Zheng et al., Highly efficient base editing in bacteria using a Cas9-cytidine deaminase fusion. Commun Biol. Apr. 19, 2018;1:32. doi: 10.1038/s42003-018-0035-5.

Zhou et al., GISSD: Group I Intron Sequence and Structure Database. Nucleic Acids Res. Jan. 2008;36(Database issue):D31-7. doi: 10.1093/nar/gkm766. Epub Oct. 16, 2007.

Zhu et al., Novel Thrombotic Function of a Human SNP in STXBP5 Revealed by CRISPR/Cas9 Gene Editing in Mice. Arterioscler Thromb Vasc Biol. Feb. 2017;37(2):264-270. doi: 10.1161/ATVBAHA.116.308614. Epub Dec. 29, 2016.

Zolotukhin et al., Production and purification of serotype 1, 2, and 5 recombinant adeno-associated viral vectors. Methods. Oct. 2002;28(2):158-67. doi: 10.1016/s1046-2023(02)00220-7.

U.S. Appl. No. 14/234,031, filed Mar. 24, 2014, Liu et al.
U.S. Appl. No. 14/320,271, filed Jun. 30, 2014, Liu et al.
U.S. Appl. No. 16/441,751, filed Jun. 14, 2019, Liu et al.
U.S. Appl. No. 14/320,519, filed Jun. 30, 2014, Liu et al.
U.S. Appl. No. 14/913,458, filed Feb. 22, 2016, Liu et al.
U.S. Appl. No. 16/266,937, filed Feb. 4, 2019, Liu et al.
U.S. Appl. No. 14/320,370, filed Jun. 30, 2014, Liu et al.
U.S. Appl. No. 14/320,413, filed Jun. 30, 2014, Liu et al.
U.S. Appl. No. 14/874,123, filed Oct. 2, 2015, Liu et al.
U.S. Appl. No. 14/911,117, filed Feb. 9, 2016, Liu et al.
U.S. Appl. No. 17/160,329, filed Jan. 27, 2021, Liu et al.
U.S. Appl. No. 14/462,163, filed Aug. 18, 2014, Liu et al.
U.S. Appl. No. 14/462,189, filed Aug. 18, 2014, Liu et al.
U.S. Appl. No. 14/916,679, filed Mar. 4, 2016, Liu et al.
U.S. Appl. No. 16/860,639, filed Apr. 28, 2020, Liu et al.
U.S. Appl. No. 14/320,498, filed Jun. 30, 2014, Liu et al.
U.S. Appl. No. 14/320,467, filed Jun. 30, 2014, Liu et al.
U.S. Appl. No. 14/916,681, filed Mar. 4, 2016, Liu et al.
U.S. Appl. No. 17/103,233, filed Nov. 24, 2020, Liu et al.
U.S. Appl. No. 14/326,329, filed Jul. 8, 2014, Liu et al.
U.S. Appl. No. 14/326,340, filed Jul. 8, 2014, Liu et al.
U.S. Appl. No. 14/326,361, filed Jul. 8, 2014, Liu et al.
U.S. Appl. No. 14/916,683, filed Mar. 4, 2016, Liu et al.
U.S. Appl. No. 16/796,323, filed Feb. 20, 2020, Liu et al.
U.S. Appl. No. 14/325,815, filed Jul. 8, 2014, Liu et al.
U.S. Appl. No. 14/326,109, filed Jul. 8, 2014, Liu et al.
U.S. Appl. No. 14/326,140, filed Jul. 8, 2014, Liu et al.
U.S. Appl. No. 14/326,269, filed Jul. 8, 2014, Liu et al.
U.S. Appl. No. 14/326,290, filed Jul. 8, 2014, Liu et al.
U.S. Appl. No. 14/326,318, filed Jul. 8, 2014, Liu et al.
U.S. Appl. No. 14/326,303, filed Jul. 8, 2014, Liu et al.
U.S. Appl. No. 15/103,608, filed Jun. 10, 2016, Liu et al.
U.S. Appl. No. 16/374,634, filed Apr. 3, 2019, Liu et al.
U.S. Appl. No. 15/329,925, filed Jan. 27, 2017, Liu et al.
U.S. Appl. No. 16/132,276, filed Sep. 14, 2018, Liu et al.
U.S. Appl. No. 16/888,646, filed May 29, 2020, Liu et al.
U.S. Appl. No. 14/529,010, filed Oct. 30, 2014, Liu et al.
U.S. Appl. No. 15/958,721, filed Apr. 20, 2018, Liu et al.
U.S. Appl. No. 17/130,812, filed Dec. 22, 2020, Liu et al.
U.S. Appl. No. 15/331,852, filed Oct. 22, 2016, Liu et al.
U.S. Appl. No. 15/960,171, filed Apr. 23, 2018, Liu et al.
U.S. Appl. No. 15/770,076, filed Apr. 20, 2018, Liu et al.
U.S. Appl. No. 16/327,744, filed Feb. 22, 2019, Maianti et al.
U.S. Appl. No. 15/852,891, filed Dec. 22, 2017, Maianti et al.
U.S. Appl. No. 16/926,436, filed Jul. 10, 2020, Maianti et al.
U.S. Appl. No. 15/852,526, filed Dec. 22, 2017, Maianti et al.
U.S. Appl. No. 16/492,534, filed Sep. 9, 2019, Liu et al.
U.S. Appl. No. 16/324,476, filed Feb. 8, 2019, Liu et al.
U.S. Appl. No. 15/791,085, filed Oct. 23, 2017, Liu et al.
U.S. Appl. No. 16/143,370, filed Sep. 26, 2018, Liu et al.
U.S. Appl. No. 17/148,059, filed Jan. 13, 2021, Liu et al.
U.S. Appl. No. 16/492,548, filed Sep. 9, 2019, Maianti et al.
U.S. Appl. No. 15/784,033, filed Oct. 13, 2017, Liu et al.
U.S. Appl. No. 16/492,553, filed Sep. 9, 2019, Liu et al.
U.S. Appl. No. 15/934,945, filed Mar. 23, 2018, Liu et al.
U.S. Appl. No. 16/643,376, filed Feb. 28, 2020, Liu et al.
U.S. Appl. No. 16/612,988, filed Nov. 12, 2019, Liu et al.
U.S. Appl. No. 16/634,405, filed Jan. 27, 2020, Liu et al.
U.S. Appl. No. 16/976,047, filed Aug. 26, 2020, Liu et al.
U.S. Appl. No. 17/289,665, filed Apr. 28, 2021, Liu et al.
U.S. Appl. No. 16/756,432, filed Apr. 15, 2020, Liu et al.
U.S. Appl. No. 16/772,747, filed Jun. 12, 2020, Shen et al.
U.S. Appl. No. 17/259,147, filed Jan. 8, 2021, Liu et al.
U.S. Appl. No. 17/270,396, filed Feb. 22, 2021, Liu et al.
U.S. Appl. No. 17/273,688, filed Mar. 4, 2021, Liu et al.
U.S. Appl. No. 17/294,287, filed May 14, 2021, Liu et al.
U.S. Appl. No. 17/288,504, filed Apr. 23, 2021, Liu et al.
U.S. Appl. No. 17/219,590, filed Mar. 31, 2021, Liu et al.
U.S. Appl. No. 17/219,635, filed Mar. 31, 2021, Liu et al.
U.S. Appl. No. 17/219,672, filed Mar. 31, 2021, Liu et al.

Abudayyeh et al., A cytosine deaminase for programmable single-base RNA editing. Science. Jul. 26, 2019;365(6451):382-386. doi: 10.1126/science.aax7063. Epub Jul. 11, 2019.

Adams et al., New biarsenical ligands and tetracysteine motifs for protein labeling in vitro and in vivo: synthesis and biological applications. J Am Chem Soc. May 29, 2002;124(21):6063-76. doi: 10.1021/ja017687n.

Aird et al., Increasing Cas9-mediated homology-directed repair efficiency through covalent tethering of DNA repair template. Commun Biol. May 31, 2018;1:54. doi: 10.1038/s42003-018-0054-2.

Akcakaya et al., In vivo CRISPR editing with no detectable genome-wide off-target mutations. Nature. Sep. 2018;561(7723):416-419. doi: 10.1038/s41586-018-0500-9. Epub Sep. 12, 2018.

Akins et al., Mitochondrial plasmids of Neurospora: integration into mitochondrial DNA and evidence for reverse transcription in mitochondria. Cell. Nov. 21, 1986;47(4):505-16. doi: 10.1016/0092-8674(86)90615-x.

Amrann et al., Tightly regulated tac promoter vectors useful for the expression of unfused and fused proteins in *Escherichia coli*. Gene. Sep. 30, 1988;69(2):301-15.

Anders et al., Chapter One: In Vitro Enzymology of Cas9. in Methods in Enzymology, eds Doudna et al. 2014: 546:1-20.

Anderson, Human gene therapy. Science. May 8, 1992;256(5058):808-13. doi: 10.1126/science.1589762.

Araki et al., Site-specific recombinase, R, encoded by yeast plasmid pSR1. J Mol Biol. May 5, 1992;225(1):25-37. doi: 10.1016/0022-2836(92)91023-i.

Arbab et al., Determinants of Base Editing Outcomes from Target Library Analysis and Machine Learning. Cell. Jul. 23, 2020;182(2):463-480.e30. doi: 10.1016/j.cell.2020.05.037. Epub Jun. 12, 2020.

Auer et al., Highly efficient CRISPR/Cas9-mediated knock-in in zebrafish by homology-independent DNA repair. Genome Res. Jan. 2014;24(1):142-53. doi: 10.1101/gr.161638.113. Epub Oct. 31, 2013.

Bacman et al., Specific elimination of mutant mitochondrial genomes in patient-derived cells by mitoTALENs. Nat Med. Sep. 2013;19(9):1111-3. doi: 10.1038/nm.3261. Epub Aug. 4, 2013.

Baldari et al., A novel leader peptide which allows efficient secretion of a fragment of human interleukin 1 beta in *Saccharomyces cerevisiae*. EMBO J. Jan. 1987;6(1):229-34.

Banerji et al., A lymphocyte-specific cellular enhancer is located downstream of the joining region in immunoglobulin heavy chain genes. Cell. Jul. 1983;33(3):729-40. doi: 10.1016/0092-8674(83)90015-6.

Bannert et al., Retroelements and the human genome: new perspectives on an old relation. Proc Natl Acad Sci U S A. Oct. 5, 2004;101 Suppl 2(Suppl 2):14572-9. doi: 10.1073/pnas.0404838101. Epub Aug. 13, 2004.

(56) References Cited

OTHER PUBLICATIONS

Barnes et al., The fidelity of Taq polymerase catalyzing PCR is improved by an N-terminal deletion. Gene. Mar. 1, 1992;112(1):29-35. doi: 10.1016/0378-1119(92)90299-5.
Behr, Gene transfer with synthetic cationic amphiphiles: prospects for gene therapy. Bioconjug Chem. Sep.-Oct. 1994;5(5):382-9. doi: 10.1021/bc00029a002.
Bennett et al., Painful and painless channelopathies. Lancet Neurol. Jun. 2014;13(6):587-99. doi: 10.1016/S1474-4422(14)70024-9. Epub May 6, 2014.
Berger et al., Reverse transcriptase and its associated ribonuclease H: interplay of two enzyme activities controls the yield of single-stranded complementary deoxyribonucleic acid. Biochemistry. May 10, 1983;22(10):2365-72. doi: 10.1021/bi00279a010.
Bernstein et al., Role for a bidentate ribonuclease in the initiation step of RNA interference. Nature. Jan. 18, 2001;409(6818):363-6. doi: 10.1038/35053110.
Blaese et al., Vectors in cancer therapy: how will they deliver? Cancer Gene Ther. Dec. 1995;2(4):291-7.
Blaisonneau et al., A circular plasmid from the yeast *Torulaspora delbrueckii*. Plasmid. 1997;38(3):202-9. doi: 10.1006/plas.1997.1315.
Bondeson et al., Inversion of the IDS gene resulting from recombination with IDS-related sequences is a common cause of the Hunter syndrome. Hum Mol Genet. Apr. 1995;4(4):615-21. doi: 10.1093/hmg/4.4.615.
Brown et al., A mammalian protein targeted by G1-arresting rapamycin-receptor complex. Nature. Jun. 30, 1994;369(6483):756-8. doi: 10.1038/369756a0.
Buckley et al., Targeting the von Hippel-Lindau E3 ubiquitin ligase using small molecules to disrupt the VHL/HIF-1? interaction. J Am Chem Soc. Mar. 14, 2012;134(10):4465-8. doi: 10.1021/ja209924v. Epub Feb. 27, 2012.
Calame et al., Transcriptional controlling elements in the immunoglobulin and T cell receptor loci. Adv Immunol. 1988;43:235-75. doi: 10.1016/s0065-2776(08)60367-3.
Camarero et al., Biosynthesis of a Head-to-Tail Cyclized Protein with Improved Biological Activity. J. Am. Chem. Soc. May 29, 1999; 121(23):5597-5598. https://doi.org/10.1021/ja990929n.
Carlier et al., Burkholderia cenocepacia H111 Rhy-family protein. Apr. 16, 2015. Retrieved from the Internet via https://www.ebi.ac.uk/ena/browser/api/embl/CDN65395.1?lineLimit=1000. Last retrieved Apr. 26, 2021.
Carr et al., Genome engineering. Nat Biotechnol. Dec. 2009;27(12):1151-62. doi: 10.1038/nbt.1590.
Chalberg et al., Integration specificity of phage phiC31 integrase in the human genome. J Mol Biol. Mar. 17, 2006;357(1):28-48. doi: 10.1016/j.jmb.2005.11.098. Epub Dec. 22, 2005.
Choi et al., Protein trans-splicing and characterization of a split family B-type DNA polymerase from the hyperthermophilic archaeal parasite Nanoarchaeum equitans. J Mol Biol. Mar. 10, 2006;356(5):1093-106. doi: 10.1016/j.jmb.2005.12.036. Epub Dec. 27, 2005.
Chong et al., Single-column purification of free recombinant proteins using a self-cleavable affinity tag derived from a protein splicing element. Gene. Jun. 19, 1997;192(2):271-81. doi: 10.1016/s0378-1119(97)00105-4.
Choulika et al., Induction of homologous recombination in mammalian chromosomes by using the I-SceI system of *Saccharomyces cerevisiae*. Mol Cell Biol. Apr. 1995;15(4):1968-73. doi: 10.1128/MCB.15.4.1968.
Cole et al., Reconstructing evolutionary adaptive paths for protein engineering. Methods Mol Biol. 2013;978:115-25. doi: 10.1007/978-1-62703-293-3_8.
Collinge, Prion diseases of humans and animals: their causes and molecular basis. Annu Rev Neurosci. 2001;24:519-50. doi: 10.1146/annurev.neuro.24.1.519.
Cotton et al., Insertion of a Synthetic Peptide into a Recombinant Protein Framework:? A Protein Biosensor. J. Am. Chem. Soc. Jan. 22, 1999; 121(5):1100-1. https://doi.org/10.1021/ja983804b.
Cox, Proteins pinpoint double strand breaks. Elife. Oct. 29, 2013;2:e01561. doi: 10.7554/eLife.01561.
Crabtree et al., Three-part inventions: intracellular signaling and induced proximity. Trends Biochem Sci. Nov. 1996;21(11):418-22. doi: 10.1016/s0968-0004(96)20027-1.
Crick, On protein synthesis. Symp Soc Exp Biol. 1958;12:138-63.
Crystal, Transfer of genes to humans: early lessons and obstacles to success. Science. Oct. 20, 1995;270(5235):404-10. doi: 10.1126/science.270.5235.404.
Dandage et al., beditor: A Computational Workflow for Designing Libraries of Guide RNAs for CRISPR-Mediated Base Editing. Genetics. Jun. 2019;212(2):377-385. doi: 10.1534/genetics.119.302089. Epub Apr. 1, 2019.
Dassa et al., Trans protein splicing of cyanobacterial split inteins in endogenous and exogenous combinations. Biochemistry. Jan. 9, 2007;46(1):322-30. doi: 10.1021/bi0611762.
DeKosky et al., Large-scale sequence and structural comparisons of human naive and antigen-experienced antibody repertoires. Proc Natl Acad Sci U S A. May 10, 2016;113(19):E2636-45. doi: 10.1073/pnas.1525510113. Epub Apr. 25, 2016.
Delebecque et al., Organization of intracellular reactions with rationally designed RNA assemblies. Science. Jul. 22, 2011;333(6041):470-4. doi: 10.1126/science.1206938. Epub Jun. 23, 2011.
Dickey et al., Single-stranded DNA-binding proteins: multiple domains for multiple functions. Structure. Jul. 2, 2013;21(7):1074-84. doi: 10.1016/j.str.2013.05.013.
Dillon, Regulating gene expression in gene therapy. Trends Biotechnol. May 1993;11(5):167-73. doi: 10.1016/0167-7799(93)90109-M.
Dingwall et al., Nuclear targeting sequences—a consensus? Trends Biochem Sci. Dec. 1991;16(12):478-81. doi: 10.1016/0968-0004(91)90184-w.
Diver et al., Single-Step Synthesis of Cell-Permeable Protein Dimerizers That Activate Signal Transduction and Gene Expression. J. Am. Chem. Soc. Jun. 4, 1997;119(22):5106-5109. https://doi.org/10.1021/ja963891c.
Dominissini et al., Topology of the human and mouse m6A RNA methylomes revealed by m6A-seq. Nature. Apr. 29, 2012;485(7397):201-6. doi: 10.1038/nature11112.
Dorgan et al., An enzyme-coupled continuous spectrophotometric assay for S-adenosylmethionine-dependent methyltransferases. Anal Biochem. Mar. 15, 2006;350(2):249-55. doi: 10.1016/j.ab.2006.01.004. Epub Feb. 7, 2006.
Dunbar et al., Gene therapy comes of age. Science. Jan. 12, 2018;359(6372):eaan4672. doi: 10.1126/science.aan4672.
Dupuy et al., Le syndrome de De La Chapelle [De La Chapelle syndrome]. Presse Med. Mar. 3, 2001;30(8):369-72. French.
Edlund et al., Cell-specific expression of the rat insulin gene: evidence for role of two distinct 5' flanking elements. Science. Nov. 22, 1985;230(4728):912-6. doi: 10.1126/science.3904002.
England, Unnatural amino acid mutagenesis: a precise tool for probing protein structure and function. Biochemistry. Sep. 21, 2004;43(37):11623-9.
Eriksson et al., Recurrent de novo point mutations in lamin A cause Hutchinson-Gilford progeria syndrome. Nature. May 15, 2003;423(6937):293-8. doi: 10.1038/nature01629. Epub Apr. 25, 2003. PMID: 12714972.
Fawcett et al., Transposable elements controlling I-R hybrid dysgenesis in *D. melanogaster* are similar to mammalian LINEs. Cell. Dec. 26, 1986;47(6):1007-15. doi: 10.1016/0092-8674(86)90815-9.
Feldstein et al., Two sequences participating in the autolytic processing of satellite tobacco ringspot virus complementary RNA. Gene. Oct. 15, 1989;82(1):53-61. doi: 10.1016/0378-1119(89)90029-2.
Filippov et al., A novel type of RNase III family proteins in eukaryotes. Gene. Mar. 7, 2000;245(1):213-21. doi: 10.1016/s0378-1119(99)00571-5.
Fire et al., Potent and specific genetic interference by double-stranded RNA in Caenorhabditis elegans. Nature. Feb. 19, 1998;391(6669):806-11. doi: 10.1038/35888.
Forster et al., Self-cleavage of virusoid RNA is performed by the proposed 55-nucleotide active site. Cell. Jul. 3, 1987;50(1):9-16. doi: 10.1016/0092-8674(87)90657-x.

(56) References Cited

OTHER PUBLICATIONS

Gaj et al., 3rd. Genome engineering with custom recombinases. Methods Enzymol. 2014;546:79-91. doi: 10.1016/B978-0-12-801185-0.00004-0.

Gao et al., Cationic liposome-mediated gene transfer. Gene Ther. Dec. 1995;2(10):710-22.

Gao et al., Self-processing of ribozyme-flanked RNAs into guide RNAs in vitro and in vivo for CRISPR-mediated genome editing. J Integr Plant Biol. Apr. 2014;56(4):343-9. doi: 10.1111/jipb.12152. Epub Mar. 6, 2014.

Gerard et al., Influence on stability in *Escherichia coli* of the carboxy-terminal structure of cloned Moloney murine leukemia virus reverse transcriptase. DNA. Aug. 1986;5(4):271-9. doi: 10.1089/dna.1986.5.271.

Gibson et al., Enzymatic assembly of DNA molecules up to several hundred kilobases. Nat Methods. May 2009;6(5):343-5. doi: 10.1038/nmeth.1318. Epub Apr. 12, 2009.

Gil, Position-dependent sequence elements downstream of AAUAAA are required for efficient rabbit beta-globin mRNA 3' end formation. Cell. May 8, 1987;49(3):399-406. doi: 10.1016/0092-8674(87)90292-3.

Gou et al., Designing single guide RNA for CIRSPR-Cas9 base editor by deep learning. Peer reviewed Thesis/Dissertation. UCLA Electronic Theses and Dissertations. Jan. 1, 2019. Retrieved from the Internet via https://escholarship.org/uc/item/7vf9z54t. Last accessed on Apr. 29, 2021.

Gumulya et al., Exploring the past and the future of protein evolution with ancestral sequence reconstruction: the 'retro' approach to protein engineering. Biochem J. Jan. 1, 2017;474(1):1-19. doi: 10.1042/BCJ20160507.

Guo et al., Facile functionalization of FK506 for biological studies by the thiol-ene 'click' reaction. RSC Advances. 2014;22:11400-3.

Gupta et al., Cross-talk between cognate and noncognate RpoE sigma factors and Zn(2+)-binding anti-sigma factors regulates photooxidative stress response in Azospirillum brasilense. Antioxid Redox Signal. Jan. 1, 2014;20(1):42-59. doi: 10.1089/ars.2013.5314. Epub Jul. 19, 2013.

Haapaniemi et al., CRISPR-Cas9 genome editing induces a p53-mediated DNA damage response. Nat Med. Jul. 2018;24(7):927-930. doi: 10.1038/s41591-018-0049-z. Epub Jun. 11, 2018.

Haddada et al., Gene therapy using adenovirus vectors. Curr Top Microbiol Immunol. 1995;199 ( Pt 3):297-306. doi: 10.1007/978-3-642-79586-2_14.

Hector et al., CDKL5 variants: Improving our understanding of a rare neurologic disorder. Neurol Genet. Dec. 15, 2017;3(6):e200. doi: 10.1212/NXG.0000000000000200.

Herschhorn et al., Retroviral reverse transcriptases. Cell Mol Life Sci. Aug. 2010;67(16):2717-47. doi: 10.1007/s00018-010-0346-2. Epub Apr. 1, 2010.

Huggins et al., Flap endonuclease 1 efficiently cleaves base excision repair and DNA replication intermediates assembled into nucleosomes. Mol Cell. Nov. 2002;10(5):1201-11. doi: 10.1016/s1097-2765(02)00736-0.

Ibba et al., Relaxing the substrate specificity of an aminoacyl-tRNA synthetase allows in vitro and in vivo synthesis of proteins containing unnatural amino acids. FEBS Lett. May 15, 1995;364(3):272-5.

Ibba et al., Substrate specificity is determined by amino acid binding pocket size in *Escherichia coli* phenylalanyl-tRNA synthetase. Biochemistry. Jun. 14, 1994;33(23):7107-12.

Ihry et al., p53 inhibits CRISPR-Cas9 engineering in human pluripotent stem cells. Nat Med. Jul. 2018;24(7):939-946. doi: 10.1038/s41591-018-0050-6. Epub Jun. 11, 2018.

Iida et al., The Min DNA inversion enzyme of plasmid p15B of *Escherichia coli* 15T-: a new member of the Din family of site-specific recombinases. Mol Microbiol. Jun. 1990;4(6):991-7. doi: 10.1111/j.1365-2958.1990.tb00671.x.

Imanishi et al., Detection of N6-methyladenosine based on the methyl-sensitivity of MazF RNA endonuclease. Chem Commun (Camb). Nov. 30, 2017;53(96):12930-12933. doi: 10.1039/c7cc07699a.

Ingram, A specific chemical difference between the globins of normal human and sickle-cell anaemia haemoglobin. Nature. Oct. 13, 1956;178(4537):792-4. doi: 10.1038/178792a0.

Irion et al., Identification and targeting of the ROSA26 locus in human embryonic stem cells. Nat Biotechnol. Dec. 2007;25(12):1477-82. doi: 10.1038/nbt1362. Epub Nov. 25, 2007.

Jardine et al., HIV-1 Vaccines. Priming a broadly neutralizing antibody response to HIV-1 using a germline-targeting immunogen. Science. Jul. 10, 2015;349(6244):156-61. doi: 10.1126/science.aac5894. Epub Jun. 18, 2015.

Jeggo, DNA breakage and repair. Adv Genet. 1998;38:185-218. doi: 10.1016/s0065-2660(08)60144-3.

Jin et al., Cytosine, but not adenine, base editors induce genome-wide off-target mutations in rice. Science. Apr. 19, 2019;364(6437):292-295. doi: 10.1126/science.aaw7166. Epub Feb. 28, 2019.

Johansson et al., RNA Recognition by the MS2 Phage Coat Protein. Seminars in Virology. 1997;8(3):176-85. https://doi.org/10.1006/smvy.1997.0120.

Johansson et al., Selenocysteine in proteins—properties and biotechnological use. Biochim Biophys Acta. Oct. 30, 2005;1726(1):1-13. Epub Jun. 1, 2005.

Jusiak et al., Comparison of Integrases Identifies Bxb1-GA Mutant as the Most Efficient Site-Specific Integrase System in Mammalian Cells. ACS Synth Biol. Jan. 18, 2019;8(1):16-24. doi: 10.1021/acssynbio.8b00089. Epub Jan. 9, 2019.

Jyothy et al., Translocation Down syndrome. Indian J Med Sci. Mar. 2002;56(3):122-6.

Kacian et al., Purification of the DNA polymerase of avian myeloblastosis virus. Biochim Biophys Acta. Sep. 24, 1971;246(3):365-83. doi: 10.1016/0005-2787(71)90773-8.

Kao et al., Cleavage specificity of *Saccharomyces cerevisiae* flap endonuclease 1 suggests a double-flap structure as the cellular substrate. J Biol Chem. Apr. 26, 2002;277(17):14379-89. doi: 10.1074/jbc.M110662200. Epub Feb. 1, 2002.

Kato et al., Improved purification and enzymatic properties of three forms of reverse transcriptase from avian myeloblastosis virus. J Virol Methods. Dec. 1984;9(4):325-39. doi: 10.1016/0166-0934(84)90058-2.

Keravala et al., A diversity of serine phage integrases mediate site-specific recombination in mammalian cells. Mol Genet Genomics. Aug. 2006;276(2):135-46. doi: 10.1007/s00438-006-0129-5. Epub May 13, 2006.

Kessel et al., Murine developmental control genes. Science. Jul. 27, 1990;249(4967):374-9. doi: 10.1126/science.1974085.

Kim et al., Genome-wide target specificity of CRISPR RNA-guided adenine base editors. Nat Biotechnol. Apr. 2019;37(4):430-435. doi: 10.1038/s41587-019-0050-1. Epub Mar. 4, 2019.

Kim et al., Evaluating and Enhancing Target Specificity of Gene-Editing Nucleases and Deaminases. Annu Rev Biochem. Jun. 20, 2019;88:191-220. doi: 10.1146/annurev-biochem-013118-111730. Epub Mar. 18, 2019.

Kleiner et al., In vitro selection of a DNA-templated small-molecule library reveals a class of macrocyclic kinase inhibitors. J Am Chem Soc. Aug. 25, 2010;132(33):11779-91. doi: 10.1021/ja104903x.

Klompe et al., Transposon-encoded CRISPR-Cas systems direct RNA-guided DNA integration. Nature. Jul. 2019;571(7764):219-225. doi: 10.1038/s41586-019-1323-z. Epub Jun. 12, 2019.

Kolot et al., Site promiscuity of coliphage HK022 integrase as a tool for gene therapy. Gene Ther. Jul. 2015;22(7):521-7. doi: 10.1038/gt.2015.9. Epub Mar. 12, 2015.

Kolot et al., Site-specific recombination in mammalian cells expressing the Int recombinase of bacteriophage HK022. Mol Biol Rep. Aug. 1999;26(3):207-13. doi: 10.1023/a:1007096701720.

Konermann et al., Genome-scale transcriptional activation by an engineered CRISPR-Cas9 complex. Nature. Jan. 29, 2015;517(7536):583-8. doi: 10.1038/nature14136. Epub Dec. 10, 2014.

(56) References Cited

OTHER PUBLICATIONS

Kotewicz et al., Cloning and overexpression of Moloney murine leukemia virus reverse transcriptase in *Escherichia coli*. Gene. 1985;35(3):249-58. doi: 10.1016/0378-1119(85)90003-4.

Kotin, Prospects for the use of adeno-associated virus as a vector for human gene therapy. Hum Gene Ther. Jul. 1994;5(7):793-801. doi: 10.1089/hum.1994.5.7-793.

Kremer et al., Adenovirus and adeno-associated virus mediated gene transfer. Br Med Bull. Jan. 1995;51(1):31-44. doi: 10.1093/oxfordjournals.bmb.a072951.

Krokan et al, Uracil in DNA—occurrence, consequences and repair. Oncogene. Dec. 16, 2002;21(58):8935-48. doi: 10.1038/sj.onc.1205996.

Kügler et al., Human synapsin 1 gene promoter confers highly neuron-specific long-term transgene expression from an adenoviral vector in the adult rat brain depending on the transduced area. Gene Ther. Feb. 2003;10(4):337-47. doi: 10.1038/sj.gt.3301905.

Kunkel et al., Eukaryotic Mismatch Repair in Relation to DNA Replication. Annu Rev Genet. 2015;49:291-313. doi: 10.1146/annurev-genet-112414-054722.

Kurjan et al., Structure of a yeast pheromone gene (MF alpha): a putative alpha-factor precursor contains four tandem copies of mature alpha-factor. Cell. Oct. 1982;30(3):933-43. doi: 10.1016/0092-8674(82)90298-7.

Kweon et al., Fusion guide RNAs for orthogonal gene manipulation with Cas9 and Cpf1. Nat Commun. Nov. 23, 2017;8(1):1723. doi: 10.1038/s41467-017-01650-w. Erratum in: Nat Commun. Jan. 16, 2018;9(1):303.

Lakich et al., Inversions disrupting the factor VIII gene are a common cause of severe haemophilia A. Nat Genet. Nov. 1993;5(3):236-41. doi: 10.1038/ng1193-236.

Landrum et al., ClinVar: public archive of relationships among sequence variation and human phenotype. Nucleic Acids Res. Jan. 2014;42(Database issue):D980-5. doi: 10.1093/nar/gkt1113. Epub Nov. 14, 2013.

Lee et al., Group I Intron-Based Therapeutics Through Trans-Splicing Reaction. Prog Mol Biol Transl Sci. 2018;159:79-100. doi: 10.1016/bs.pmbts.2018.07.001. Epub Aug. 9, 2018.

Lee et al., Targeted chromosomal deletions in human cells using zinc finger nucleases. Genome Res. Jan. 2010 20: 81-89; Published in Advance Dec. 1, 2009, doi:10.1101/gr.099747.109.

Lewis et al., RNA modifications and structures cooperate to guide RNA-protein interactions. Nat Rev Mol Cell Biol. Mar. 2017;18(3):202-210. doi: 10.1038/nrm.2016.163. Epub Feb. 1, 2017.

Li et al., Disruption of splicing-regulatory elements using CRISPR/Cas9 to rescue spinal muscular atrophy in human iPSCs and mice. National Science Review. Jan. 1, 2020:92-101. DOI: 10.1093/nsr/nwz131. Retrieved from the Internet via https://academic.oup.com/nsr/article-pdf/7/1/92/33321439/nwz131.pdf. Last accessed Apr. 28, 2021.

Li et al., Loss of post-translational modification sites in disease. Pac Symp Biocomput. 2010:337-47. doi: 10.1142/9789814295291_0036.

Li et al., RSEM: accurate transcript quantification from RNA-Seq data with or without a reference genome. BMC Bioinformatics. Aug. 4, 2011;12:323. doi: 10.1186/1471-2105-12-323.

Liang et al., Homology-directed repair is a major double-strand break repair pathway in mammalian cells. Proc Natl Acad Sci U S A. Apr. 28, 1998;95(9):5172-7. doi: 10.1073/pnas.95.9.5172.

Liu et al., Adding new chemistries to the genetic code. Annu Rev Biochem. 2010;79:413-44. doi: 10.1146/annurev.biochem.052308.105824.

Liu et al., Calcineurin is a common target of cyclophilin-cyclosporin A and FKBP-FK506 complexes. Cell. Aug. 23, 1991;66(4):807-15. doi: 10.1016/0092-8674(91)90124-h.

Liu et al., Flap endonuclease 1: a central component of DNA metabolism. Annu Rev Biochem. 2004;73:589-615. doi:10.1146/annurev.biochem.73.012803.092453.

Liu et al., Genetic incorporation of unnatural amino acids into proteins in mammalian cells. Nat Methods. Mar. 2007;4(3):239-44. Epub Feb. 25, 2007.

Liu et al., Reverse transcriptase of foamy virus. Purification of the enzymes and immunological identification. Arch Virol. 1977;55(3):187-200. doi: 10.1007/BF01319905.

Liu et al., Reverse transcriptase-mediated tropism switching in Bordetella bacteriophage. Science. Mar. 15, 2002;295(5562):2091-4. doi: 10.1126/science.1067467.

Liu et al., *Saccharomyces cerevisiae* flap endonuclease 1 uses flap equilibration to maintain triplet repeat stability. Mol Cell Biol. May 2004;24(9):4049-64. doi: 10.1128/MCB.24.9.4049-4064.2004.

Lopez-Girona et al., Cereblon is a direct protein target for immunomodulatory and antiproliferative activities of lenalidomide and pomalidomide. Leukemia. Nov. 2012;26(11):2326-35. doi: 10.1038/leu.2012.119. Epub May 3, 2012.

Lorenz et al., ViennaRNA Package 2.0. Algorithms Mol Biol. Nov. 24, 2011;6:26. doi: 10.1186/1748-7188-6-26.

Luan et al., Reverse transcription of R2Bm RNA is primed by a nick at the chromosomal target site: a mechanism for non-LTR retrotransposition. Cell. Feb. 26, 1993;72(4):595-605. doi: 10.1016/0092-8674(93)90078-5.

Luckow et al., High level expression of nonfused foreign genes with Autographa californica nuclear polyhedrosis virus expression vectors. Virology. May 1989;170(1):31-9. doi: 10.1016/0042-6822(89)90348-6.

Lukacsovich et al., Repair of a specific double-strand break generated within a mammalian chromosome by yeast endonuclease I-SceI. Nucleic Acids Res. Dec. 25, 1994;22(25):5649-57. doi: 10.1093/nar/22.25.5649.

Lüke et al., Partial purification and characterization of the reverse transcriptase of the simian immunodeficiency virus TYO-7 isolated from an African green monkey. Biochemistry. Feb. 20, 1990;29(7):1764-9. doi: 10.1021/bi00459a015.

Ma et al., Identification of pseudo attP sites for phage phiC31 integrase in bovine genome. Biochem Biophys Res Commun. Jul. 7, 2006;345(3):984-8. doi: 10.1016/j.bbrc.2006.04.145. Epub May 3, 2006.

Ma et al., In vitro protein engineering using synthetic tRNA(Ala) with different anticodons. Biochemistry. Aug. 10, 1993;32(31):7939-45.

Ma et al., PhiC31 integrase induces efficient site-specific recombination in the Capra hircus genome. DNA Cell Biol. Aug. 2014;33(8):484-91. doi: 10.1089/dna.2013.2124. Epub Apr. 22, 2014.

Macrae et al., Ribonuclease revisited: structural insights into ribonuclease III family enzymes. Curr Opin Struct Biol. Feb. 2007;17(1):138-45. doi: 10.1016/j.sbi.2006.12.002. Epub Dec. 27, 2006.

Marceau, Functions of single-strand DNA-binding proteins in DNA replication, recombination, and repair. Methods Mol Biol. 2012;922:1-21. doi: 10.1007/978-1-62703-032-8_1.

Maresca et al., Obligate ligation-gated recombination (ObLiGaRe): custom-designed nuclease-mediated targeted integration through nonhomologous end joining. Genome Res. Mar. 2013;23(3):539-46. Doi: 10.1101/gr.145441.112. Epub Nov. 14, 2012.

Marquart et al., Predicting base editing outcomes with an attention-based deep learning algorithm trained on high-throughput target library screeen. bioRxiv. Jul. 5, 2020. DOI:10.1101/2020.07.05.186544. Retrieved from the Internet via https://www.biorxiv.org/content/10.1101/2020.07.05.186544v1.full.pdf lased accessed on Apr. 28, 2021.

Martsolf et al., Complete trisomy 17p a relatively new syndrome. Ann Genet. 1988;31(3):172-4.

Mathys et al., Characterization of a self-splicing mini-intein and its conversion into autocatalytic N- and C-terminal cleavage elements: facile production of protein building blocks for protein ligation. Gene. Apr. 29, 1999;231(1-2):1-13. doi: 10.1016/s0378-1119(99)00103-1.

McCarroll et al., Copy-number variation and association studies of human disease. Nat Genet. Jul. 2007;39(7 Suppl):S37-42. doi: 10.1038/ng2080.

McDonald et al., Characterization of mutations at the mouse phenylalanine hydroxylase locus. Genomics. Feb. 1, 1997;39(3):402-5. doi: 10.1006/geno.1996.4508.

(56) References Cited

OTHER PUBLICATIONS

Meinke et al., Cre Recombinase and Other Tyrosine Recombinases. Chem Rev. Oct. 26, 2016;116(20):12785-12820. doi: 10.1021/acs.chemrev.6b00077. Epub May 10, 2016.

Michel et al., Mitochondrial class II introns encode proteins related to the reverse transcriptases of retroviruses. Nature. Aug. 15-21, 1985;316(6029):641-3. doi: 10.1038/316641a0.

Mijakovic et al., Bacterial single-stranded DNA-binding proteins are phosphorylated on tyrosine. Nucleic Acids Res. Mar. 20, 2006;34(5):1588-96. doi: 10.1093/nar/gkj514.

Miller, Human gene therapy comes of age. Nature. Jun. 11, 1992;357(6378):455-60. doi: 10.1038/357455a0.

Mitani et al., Delivering therapeutic genes—matching approach and application. Trends Biotechnol. May 1993;11(5):162-6. doi: 10.1016/0167-7799(93)90108-L.

Miyaoka et al., Systematic quantification of HDR and NHEJ reveals effects of locus, nuclease, and cell type on genome-editing. Sci Rep. Mar. 31, 2016;6:23549. doi: 10.1038/srep23549.

Mok et al., A bacterial cytidine deaminase toxin enables CRISPR-free mitochondrial base editing. Nature. Jul. 2020;583(7817):631-637. doi: 10.1038/s41586-020-2477-4. Epub Jul. 8, 2020.

Molla et al., CRISPR/Cas-Mediated Base Editing: Technical Considerations and Practical Applications. Trends Biotechnol. Oct. 2019;37(10):1121-1142. doi: 10.1016/j.tibtech.2019.03.008. Epub Apr. 14, 2019.

Mumtsidu et al., Structural features of the single-stranded DNA-binding protein of Epstein-Barr virus. J Struct Biol. Feb. 2008;161(2):172-87. doi: 10.1016/j.jsb.2007.10.014. Epub Nov. 1, 2007.

Myers et al., Insulin signal transduction and the IRS proteins. Annu Rev Pharmacol Toxicol. 1996;36:615-58. doi: 10.1146/annurev.pa.36.040196.003151.

Nahar et al., A G-quadruplex motif at the 3' end of sgRNAs improves CRISPR-Cas9 based genome editing efficiency. Chem Commun (Camb). Mar. 7, 2018;54(19):2377-2380. doi: 10.1039/c7cc08893k. Epub Feb. 16, 2018.

Newby et al., Base editing of haematopoietic stem cells rescues sickle cell disease in mice. Nature. Jun. 2, 2021. doi: 10.1038/s41586-021-03609-w. Epub ahead of print.

Nowak et al., Characterization of single-stranded DNA-binding proteins from the psychrophilic bacteria *Desulfotalea psychrophila, Flavobacterium psychrophilum, Psychrobacter arcticus, Psychrobacter cryohalolentis, Psychromonas ingrahamii, Psychroflexus torquis,* and *Photobacterium profundum*. BMC Microbiol. Apr. 14, 2014;14:91. doi: 10.1186/1471-2180-14-91.

Oakes et al., Profiling of engineering hotspots identifies an allosteric CRISPR-Cas9 switch. Nat Biotechnol. Jun. 2016;34(6):646-51. doi: 10.1038/nbt.3528. Epub May 2, 2016.

Olivares et al., Site-specific genomic integration produces therapeutic Factor IX levels in mice. Nat Biotechnol. Nov. 2002;20(11):1124-8. doi: 10.1038/nbt753. Epub Oct. 15, 2002.

Olorunniji et al., Purification and In Vitro Characterization of Zinc Finger Recombinases. Methods Mol Biol. 2017;1642:229-245. doi: 10.1007/978-1-4939-7169-5_15.

Olorunniji et al., Site-specific recombinases: molecular machines for the Genetic Revolution. Biochem J. Mar. 15, 2016;473(6):673-84. doi: 10.1042/BJ20151112.

Ortiz-Urda et al., Stable nonviral genetic correction of inherited human skin disease. Nat Med. Oct. 2002;8(10):1166-70. doi: 10.1038/nm766. Epub Sep. 16, 2002. Erratum in: Nat Med. Feb. 2003;9(2):237.

Ostertag et al., Biology of mammalian L1 retrotransposons. Annu Rev Genet. 2001;35:501-38. doi: 10.1146/annurev.genet.35.102401.091032.

Otomo et al., Improved segmental isotope labeling of proteins and application to a larger protein. J Biomol NMR. Jun. 1999;14(2):105-14. doi: 10.1023/a:1008308128050.

Otomo et al., NMR observation of selected segments in a larger protein: central-segment isotope labeling through intein-mediated ligation. Biochemistry. Dec. 7, 1999;38(49):16040-4. doi: 10.1021/bi991902j.

Paiva et al., Targeted protein degradation: elements of PROTAC design. Curr Opin Chem Biol. Jun. 2019;50:111-119. doi: 10.1016/j.cbpa.2019.02.022. Epub Apr. 17, 2019.

Perler et al., Protein splicing and autoproteolysis mechanisms. Curr Opin Chem Biol. Oct. 1997;1(3):292-9. doi: 10.1016/s1367-5931(97)80065-8.

Popp et al., Sortagging: a versatile method for protein labeling. Nat Chem Biol. Nov. 2007;3(11):707-8. doi: 10.1038/nchembio.2007.31. Epub Sep. 23, 2007.

Pruschy et al., Mechanistic studies of a signaling pathway activated by the organic dimerizer FK1012. Chem Biol. Nov. 1994;1(3):163-72. doi: 10.1016/1074-5521(94)90006-x.

Queen et al., Immunoglobulin gene transcription is activated by downstream sequence elements. Cell. Jul. 1983;33(3):741-8. doi: 10.1016/0092-8674(83)90016-8.

Raina et al., PROTAC-induced BET protein degradation as a therapy for castration-resistant prostate cancer. Proc Natl Acad Sci U S A. Jun. 28, 2016;113(26):7124-9. doi: 10.1073/pnas.1521738113. Epub Jun. 6, 2016.

Ramamurthy et al., Identification of immunogenic B-cell epitope peptides of rubella virus E1 glycoprotein towards development of highly specific immunoassays and/or vaccine. Conference Abstract. 2019.

Rashel et al., A novel site-specific recombination system derived from bacteriophage phiMR11. Biochem Biophys Res Commun. Apr. 4, 2008;368(2):192-8. doi: 10.1016/j.bbrc.2008.01.045. Epub Jan. 22, 2008.

Remy et al., Gene transfer with a series of lipophilic DNA-binding molecules. Bioconjug Chem. Nov.-Dec. 1994;5(6):647-54. doi: 10.1021/bc00030a021.

Risso et al., Hyperstability and substrate promiscuity in laboratory resurrections of Precambrian ?-lactamases. J Am Chem Soc. Feb. 27, 2013;135(8):2899-902. doi: 10.1021/ja311630a. Epub Feb. 14, 2013.

Ritchie et al., limma powers differential expression analyses for RNA-sequencing and microarray studies. Nucleic Acids Res. Apr. 20, 2015;43(7):e47. doi: 10.1093/nar/gkv007. Epub Jan. 20, 2015.

Robinson et al., The protein tyrosine kinase family of the human genome. Oncogene. Nov. 20, 2000;19(49):5548-57. doi: 10.1038/sj.onc.1203957.

Rubio et al., Transfer RNA travels from the cytoplasm to organelles. Wiley Interdiscip Rev RNA. Nov.-Dec. 2011;2(6):802-17. doi: 10.1002/wrna.93. Epub Jul. 11, 2011.

Ryu et al., Adenine base editing in mouse embryos and an adult mouse model of Duchenne muscular dystrophy. Nat Biotechnol. Jul. 2018;36(6):536-539. doi: 10.1038/nbt.4148. Epub Apr. 27, 2018.

Sarkar et al., HIV-1 proviral DNA excision using an evolved recombinase. Science. Jun. 29, 2007;316(5833):1912-5. doi: 10.1126/science.1141453.

Savic et al., Covalent linkage of the DNA repair template to the CRISPR-Cas9 nuclease enhances homology-directed repair. Elife. May 29, 2018;7:e33761. doi: 10.7554/eLife.33761.

Saville et al., A site-specific self-cleavage reaction performed by a novel RNA in Neurospora mitochondria. Cell. May 18, 1990;61(4):685-96. doi: 10.1016/0092-8674(90)90480-3.

Schultz et al., Expression and secretion in yeast of a 400-kDa envelope glycoprotein derived from Epstein-Barr virus. Gene. 1987;54(1):113-23. doi: 10.1016/0378-1119(87)90353-2.

Seed, An LFA-3 cDNA encodes a phospholipid-linked membrane protein homologous to its receptor CD2. Nature. Oct. 29-Nov. 4, 1987;329(6142):840-2. doi: 10.1038/329840a0.

Setten et al., The current state and future directions of RNAi-based therapeutics. Nat Rev Drug Discov. Jun. 2019;18(6):421-446. doi: 10.1038/s41573-019-0017-4.

Sha et al., Monobodies and other synthetic binding proteins for expanding protein science. Protein Sci. May 2017;26(5):910-924. doi: 10.1002/pro.3148. Epub Mar. 24, 2017.

Shingledecker et al., Molecular dissection of the *Mycobacterium tuberculosis* RecA intein: design of a minimal intein and of a trans-splicing system involving two intein fragments. Gene. Jan. 30, 1998;207(2):187-95. doi: 10.1016/s0378-1119(97)00624-0.

(56) References Cited

OTHER PUBLICATIONS

Singh et al., Real-time observation of DNA recognition and rejection by the RNA-guided endonuclease Cas9. Nat Commun. Sep. 14, 2016;7:12778. doi: 10.1038/ncomms12778.
Smith et al., Single-step purification of polypeptides expressed in *Escherichia coli* as fusions with glutathione S-transferase. Gene. Jul. 15, 1988;67(1):31-40. doi: 10.1016/0378-1119(88)90005-4.
Sommerfelt et al., Receptor interference groups of 20 retroviruses plating on human cells. Virology. May 1990;176(1):58-69. doi: 10.1016/0042-6822(90)90230-o.
Spencer et al., Controlling signal transduction with synthetic ligands. Science. Nov. 12, 1993;262(5136):1019-24. doi: 10.1126/science.7694365.
Stadtman, Selenocysteine. Annu Rev Biochem. 1996;65:83-100.
Stella et al., Structure of the Cpf1 endonuclease R-loop complex after target DNA cleavage. Nature. Jun. 22, 2017;546(7659):559-563. doi: 10.1038/nature22398. Epub May 31, 2017.
Stenson et al., The Human Gene Mutation Database: towards a comprehensive repository of inherited mutation data for medical research, genetic diagnosis and next-generation sequencing studies. Hum Genet. Jun. 2017;136(6):665-677. doi: 10.1007/s00439-017-1779-6. Epub Mar. 27, 2017.
Sternberg et al., Conformational control of DNA target cleavage by CRISPR-Cas9. Nature. Nov. 5, 2015;527(7576):110-3. doi: 10.1038/nature15544. Epub Oct. 28, 2015.
Strecker et al., RNA-guided DNA insertion with CRISPR-associated transposases. Science. Jul. 5, 2019;365(6448):48-53. doi: 10.1126/science.aax9181. Epub Jun. 6, 2019.
Takimoto et al., Stereochemical basis for engineered pyrrolysyl-tRNA synthetase and the efficient in vivo incorporation of structurally divergent non-native amino acids. ACS Chem Biol. Jul. 15, 2011;6(7):733-43. doi: 10.1021/cb200057a. Epub May 5, 2011.
Tanese et al., Expression of enzymatically active reverse transcriptase in *Escherichia coli*. Proc Natl Acad Sci U S A. Aug. 1985;82(15):4944-8. doi: 10.1073/pnas.82.15.4944.
Thomson et al., Mutational analysis of loxP sites for efficient Cre-mediated insertion into genomic DNA. Genesis. Jul. 2003;36(3):162-7. doi: 10.1002/gene.10211.
Tone et al., Single-stranded DNA binding protein Gp5 of Bacillus subtilis phage ?29 is required for viral DNA replication in growth-temperature dependent fashion. Biosci Biotechnol Biochem. 2012;76(12):2351-3. doi: 10.1271/bbb.120587. Epub Dec. 7, 2012.
Toro et al., On the Origin and Evolutionary Relationships of the Reverse Transcriptases Associated With Type III CRISPR-Cas Systems. Front Microbiol. Jun. 15, 2018;9:1317. doi: 10.3389/fmicb.2018.01317.
Toro et al., The Reverse Transcriptases Associated with CRISPR-Cas Systems. Sci Rep. Aug. 2, 2017;7(1):7089. doi: 10.1038/s41598-017-07828-y.
UniProtein A0A1V6. Dec. 11, 2019.
Van Brunt et al., Genetically Encoded Azide Containing Amino Acid in Mammalian Cells Enables Site-Specific Antibody-Drug Conjugates Using Click Cycloaddition Chemistry. Bioconjug Chem. Nov. 18, 2015;26(11):2249-60. doi: 10.1021/acs.bioconjchem.5b00359. Epub Sep. 11, 2015.
Varga et al., Progressive vascular smooth muscle cell defects in a mouse model of Hutchinson-Gilford progeria syndrome. Proc Natl Acad Sci U S A. Feb. 28, 2006;103(9):3250-5. doi: 10.1073/pnas.0600012103. Epub Feb. 21, 2006.
Vellore et al., A group II intron-type open reading frame from the thermophile Bacillus (Geobacillus) stearothermophilus encodes a heat-stable reverse transcriptase. Appl Environ Microbiol. Dec. 2004;70(12):7140-7. doi: 10.1128/AEM.70.12.7140-7147.2004.
Verma, The reverse transcriptase. Biochim Biophys Acta. Mar. 21, 1977;473(1):1-38. doi: 10.1016/0304-419x(77)90005-1.
Vigne et al., Third-generation adenovectors for gene therapy. Restor Neurol Neurosci. Jan. 1, 1995;8(1):35-6. doi: 10.3233/RNN-1995-81208.
Vilenchik et al., Endogenous DNA double-strand breaks: production, fidelity of repair, and induction of cancer. Proc Natl Acad Sci U S A. Oct. 28, 2003;100(22):12871-6. doi: 10.1073/pnas.2135498100. Epub Oct. 17, 2003.
Wang et al., Expanding the genetic code. Annu Rev Biophys Biomol Struct. 2006;35:225-49. Review.
Wang et al., Highly efficient CRISPR/HDR-mediated knock-in for mouse embryonic stem cells and zygotes. Biotechniques. 2015:59,201-2;204;206-8.
Wang et al., Structural basis of N(6)-adenosine methylation by the METTL3-METTL14 complex. Nature. Jun. 23, 2016;534(7608):575-8. doi: 10.1038/nature18298. Epub May 25, 2016.
Waxman et al., Regulating excitability of peripheral afferents: emerging ion channel targets. Nat Neurosci. Feb. 2014;17(2):153-63. doi: 10.1038/nn.3602. Epub Jan. 28, 2014.
Weinert et al., Unbiased detection of CRISPR off-targets in vivo using DISCOVER-Seq. Science. Apr. 19, 2019;364(6437):286-289. doi: 10.1126/science.aav9023. Epub Apr. 18, 2019.
West et al., Gene expression in adeno-associated virus vectors: the effects of chimeric mRNA structure, helper virus, and adenovirus VA1 RNA. Virology. Sep. 1987;160(1):38-47. doi: 10.1016/0042-6822(87)90041-9.
Winter et al., Drug Development. Phthalimide conjugation as a strategy for in vivo target protein degradation. Science. Jun. 19, 2015;348(6241):1376-81. doi:; 10.1126/science.aab1433. Epub May 21, 2015.
Winter et al., Targeted exon skipping with AAV-mediated split adenine base editors. Cell Discov. Aug. 20, 2019;5:41. doi: 10.1038/s41421-019-0109-7.
Wold, Replication protein A: a heterotrimeric, single-stranded DNA-binding protein required for eukaryotic DNA metabolism. Annu Rev Biochem. 1997;66:61-92. doi: 10.1146/annurev.biochem.66.1.61.
Wood et al., A genetic system yields self-cleaving inteins for bioseparations. Nat Biotechnol. Sep. 1999;17(9):889-92. doi: 10.1038/12879.
Wu et al., Human single-stranded DNA binding proteins: guardians of genome stability. Acta Biochim Biophys Sin (Shanghai). Jul. 2016;48(7):671-7. doi: 10.1093/abbs/gmw044. Epub May 23, 2016.
Wu et al., Protein trans-splicing and functional mini-inteins of a cyanobacterial dnaB intein. Biochim Biophys Acta. Sep. 8, 1998;1387(1-2):422-32. doi: 10.1016/s0167-4838(98)00157-5.
Wu et al., Readers, writers and erasers of N6-methylated adenosine modification. Curr Opin Struct Biol. Dec. 2017;47:67-76. doi: 10.1016/j.sbi.2017.05.011. Epub Jun. 16, 2017.
Xiao et al., Genetic incorporation of multiple unnatural amino acids into proteins in mammalian cells. Angew Chem Int Ed Engl. Dec. 23, 2013;52(52):14080-3. doi: 10.1002/anie.201308137. Epub Nov. 8, 2013.
Xie et al., Adjusting the attB site in donor plasmid improves the efficiency of ?C31 integrase system. DNA Cell Biol. Jul. 2012;31(7):1335-40. doi: 10.1089/dna.2011.1590. Epub Apr. 10, 2012.
Xu et al., PTMD: A Database of Human Disease-associated Post-translational Modifications. Genomics Proteomics Bioinformatics. Aug. 2018;16(4):244-251. doi: 10.1016/j.gpb.2018.06.004. Epub Sep. 21, 2018.
Yamazaki et al., Segmental Isotope Labeling for Protein NMR Using Peptide Splicing. J. Am. Chem. Soc. May 22, 1998; 120(22):5591-2. https://doi.org/10.1021/ja980776o.
Yang et al., Preparation of RNA-directed DNA polymerase from spleens of Balb-c mice infected with Rauscher leukemia virus. Biochem Biophys Res Commun. Apr. 28, 1972;47(2):505-11. doi: 10.1016/0006-291x(72)90743-7.
Yokoe et al., Spatial dynamics of GFP-tagged proteins investigated by local fluorescence enhancement. Nat Biotechnol. Oct. 1996;14(10):1252-6. doi: 10.1038/nbt1096-1252.
Yu et al., Progress towards gene therapy for HIV infection. Gene Ther. Jan. 1994;1(1):13-26.
Zhang et al., A new strategy for the site-specific modification of proteins in vivo. Biochemistry. Jun. 10, 2003;42(22):6735-46.
Zhang et al., Myoediting: Toward Prevention of Muscular Dystrophy by Therapeutic Genome Editing. Physiol Rev. Jul. 1, 2018;98(3):1205-1240. doi: 10.1152/physrev.00046.2017.

(56) References Cited

OTHER PUBLICATIONS

Zheng et al., Structural basis for the complete resistance of the human prion protein mutant G127V to prion disease. Sci Rep. Sep. 4, 2018;8(1):13211. doi: 10.1038/s41598-018-31394-6.

Zhou et al., Off-target RNA mutation induced by DNA base editing and its elimination by mutagenesis. Nature. Jul. 2019;571(7764):275-278. doi: 10.1038/s41586-019-1314-0. Epub Jun. 10, 2019.

Zhou et al., Seamless Genetic Conversion of SMN2 to SMN1 via CRISPR/Cpf1 and Single-Stranded Oligodeoxynucleotides in Spinal Muscular Atrophy Patient-Specific Induced Pluripotent Stem Cells. Hum Gene Ther. Nov. 2018;29(11):1252-1263. doi: 10.1089/hum.2017.255. Epub May 9, 2018.

Zielenski, Genotype and phenotype in cystic fibrosis. Respiration. 2000;67(2):117-33. doi: 10.1159/000029497.

Alizadeh et al., HR9: An Important Cell Penetrating Peptide for Delivery of HCV NS3 DNA into HEK-293T Cells. Avicenna J Med Biotechnol. Jan.-Mar. 2020;12(1):44-51.

Avidan et al., Expression and characterization of a recombinant novel reverse transcriptase of a porcine endogenous retrovirus. Virology. Mar. 15, 2003;307(2):341-57. doi: 10.1016/s0042-6822(02)00131-9.

Bae et al., Heteroclitic CD33 peptide with enhanced anti-acute myeloid leukemic immunogenicity. Clin Cancer Res. Oct. 15, 2004;10(20):7043-52. doi: 10.1158/1078-0432.CCR-04-0322.

Baños-Sanz et al., Crystal structure and functional insights into uracil-DNA glycosylase inhibition by phage Φ29 DNA mimic protein p56. Nucleic Acids Res. Jul. 2013;41(13):6761-73. doi: 10.1093/nar/gkt395. Epub May 13, 2013.

Choi et al., Optimization of AAV expression cassettes to improve packaging capacity and transgene expression in neurons. Mol Brain. Mar. 11, 2014;7:17. doi: 10.1186/1756-6606-7-17.

Ekman et al., CRISPR-Cas9-Mediated Genome Editing Increases Lifespan and Improves Motor Deficits in a Huntington's Disease Mouse Model. Mol Ther Nucleic Acids. Sep. 6, 2019;17:829-839. doi: 10.1016/j.omtn.2019.07.009. Epub Jul. 26, 2019.

Eriksen et al., Occlusion of the Ribosome Binding Site Connects the Translational Initiation Frequency, mRNA Stability and Premature Transcription Termination. Front Microbiol. Mar. 14, 2017;8:362. doi: 10.3389/fmicb.2017.00362.

Fikes et al., Design of multi-epitope, analogue-based cancer vaccines. Expert Opin Biol Ther. Sep. 2003;3(6):985-93. doi: 10.1517/14712598.3.6.985.

Genbank Submission; NIH/NCBI, Accession No. NP_060228.2. Bi et al., Dec. 21, 2005. 1 page.

Genbank Submission; NIH/NCBI, Accession No. NP_062826.2. Bokar et al., Sep. 18, 2004. 2 pages.

Genbank Submission; NIH/NCBI, Accession No. NP_066012.1. Ota et al., Apr. 3, 2005. 2 pages.

Genbank Submission; NIH/NCBI, Accession No. WP_042518169.1. No Author, Feb. 10, 2015. 1 page.

Hizi et al., Retroviral reverse transcriptases (other than those of HIV-1 and murine leukemia virus): a comparison of their molecular and biochemical properties. Virus Res. Jun. 2008;134(1-2):203-20. doi: 10.1016/j.virusres.2007.12.008. Epub Mar. 3, 2008.

Houghton et al., Immunological validation of the EpitOptimizer program for streamlined design of heteroclitic epitopes. Vaccine. Jul. 20, 2007;25(29):5330-42. doi: 10.1016/j.vaccine.2007.05.008. Epub Jun. 4, 2007.

Hu et al., Discovery and engineering of small SlugCas9 with broad targeting range and high specificity and activity. Nucleic Acids Res. Apr. 19, 2021;49(7):4008-4019. doi: 10.1093/nar/gkab148.

Hwang et al., Heritable and precise zebrafish genome editing using a CRISPR-Cas system. PLoS One. Jul. 9, 2013;8(7):e68708. doi: 10.1371/journal.pone.0068708.

Karimian et al., CRISPR/Cas9 novel therapeutic road for the treatment of neurodegenerative diseases. Life Sci. Oct. 15, 2020;259:118165. doi: 10.1016/j.lfs.2020.118165. Epub Jul. 29, 2020.

Kirshenboim et al., Expression and characterization of a novel reverse transcriptase of the LTR retrotransposon Tf1. Virology. Sep. 30, 2007;366(2):263-76. doi: 10.1016/j.virol.2007.04.002. Epub May 23, 2007.

Lee et al., Mitochondrial DNA editing in mice with DddA-TALE fusion deaminases. Nat Commun. Feb. 19, 2021;12(1):1190. doi: 10.1038/s41467-021-21464-1.

Misra et al., An enzymatically active chimeric HIV-1 reverse transcriptase (RT) with the RNase-H domain of murine leukemia virus RT exists as a monomer. J Biol Chem. Apr. 17, 1998;273(16):9785-9. doi: 10.1074/jbc.273.16.9785.

Nowak et al., Ty3 reverse transcriptase complexed with an RNA-DNA hybrid shows structural and functional asymmetry. Nat Struct Mol Biol. Apr. 2014;21(4):389-96. doi: 10.1038/nsmb.2785. Epub Mar. 9, 2014. Author Manuscript, 22 pages.

Raaijmakers et al., CRISPR/Cas Applications in Myotonic Dystrophy: Expanding Opportunities. Int J Mol Sci. Jul. 27, 2019;20(15):3689. doi: 10.3390/ijms20153689.

Riddle et al., Frameshift suppression: a nucleotide addition in the anticodon of a glycine transfer RNA. Nat New Biol. Apr. 25, 1973;242(121):230-4. doi: 10.1038/newbio242230a0.

Riddle et al., Frameshift suppressors. II. Genetic mapping and dominance studies. J Mol Biol. May 28, 1972;66(3):483-93. doi: 10.1016/0022-2836(72)90428-7.

Riddle et al., Suppressors of frameshift mutations in *Salmonella typhimurium*. J Mol Biol. Nov. 28, 1970;54(1):131-44. doi: 10.1016/0022-2836(70)90451-1.

Sadowski et al., The sequence-structure relationship and protein function prediction. Curr Opin Struct Biol. Jun. 2009;19(3):357-62. doi: 10.1016/j.sbi.2009.03.008. Epub May 4, 2009.

Seffernick et al., Melamine deaminase and atrazine chlorohydrolase: 98 percent identical but functionally different. J Bacteriol. Apr. 2001;183(8):2405-10. doi: 10.1128/JB.183.8.2405-2410.2001.

Shalaby et al., Tissue-Specific Delivery of CRISPR Therapeutics: Strategies and Mechanisms of Non-Viral Vectors. Int J Mol Sci. Oct. 5, 2020;21(19):7353. doi: 10.3390/ijms21197353.

Simon et al., Retrons and their applications in genome engineering. Nucleic Acids Res. Dec. 2, 2019;47(21):11007-11019. doi: 10.1093/nar/gkz865.

Singh et al., Protein Engineering Approaches in the Post-Genomic Era. Curr Protein Pept Sci. 2018;19(1):5-15. doi: 10.2174/1389203718666161117114243.

Studebaker et al., Depletion of uracil-DNA glycosylase activity is associated with decreased cell proliferation. Biochem Biophys Res Commun. Aug. 26, 2005;334(2):509-15. doi: 10.1016/j.bbrc.2005.06.118.

Suh et al., Publisher Correction: Restoration of visual function in adult mice with an inherited retinal disease via adenine base editing. Nat Biomed Eng. Nov. 2020;4(11):1119. doi: 10.1038/s41551-020-00652-2. Erratum for: Nat Biomed Eng. Oct. 19, 2020.

Tang et al., Identification of Dehalobacter reductive dehalogenases that catalyse dechlorination of chloroform, 1,1,1-trichloroethane and 1,1-dichloroethane. Philos Trans R Soc Lond B Biol Sci. Mar. 11, 2013;368(1616):20120318. doi: 10.1098/rstb.2012.0318.

Toro et al., Comprehensive phylogenetic analysis of bacterial reverse transcriptases. PLoS One. Nov. 25, 2014;9(11):e114083. doi: 10.1371/journal.pone.0114083.

Witkowski et al., Conversion of a beta-ketoacyl synthase to a malonyl decarboxylase by replacement of the active-site cysteine with glutamine. Biochemistry. Sep. 7, 1999;38(36):11643-50. doi: 10.1021/bi990993h.

Yin et al., Optimizing genome editing strategy by primer-extension-mediated sequencing. Cell Discov. Mar. 26, 2019;5:18. doi: 10.1038/s41421-019-0088-8.

Zhang et al., Propagated Perturbations from a Peripheral Mutation Show Interactions Supporting WW Domain Thermostability. Structure. Nov. 6, 2018;26(11):1474-1485.e5. doi: 10.1016/j.str.2018.07.014. Epub Sep. 6, 2018.

\* cited by examiner

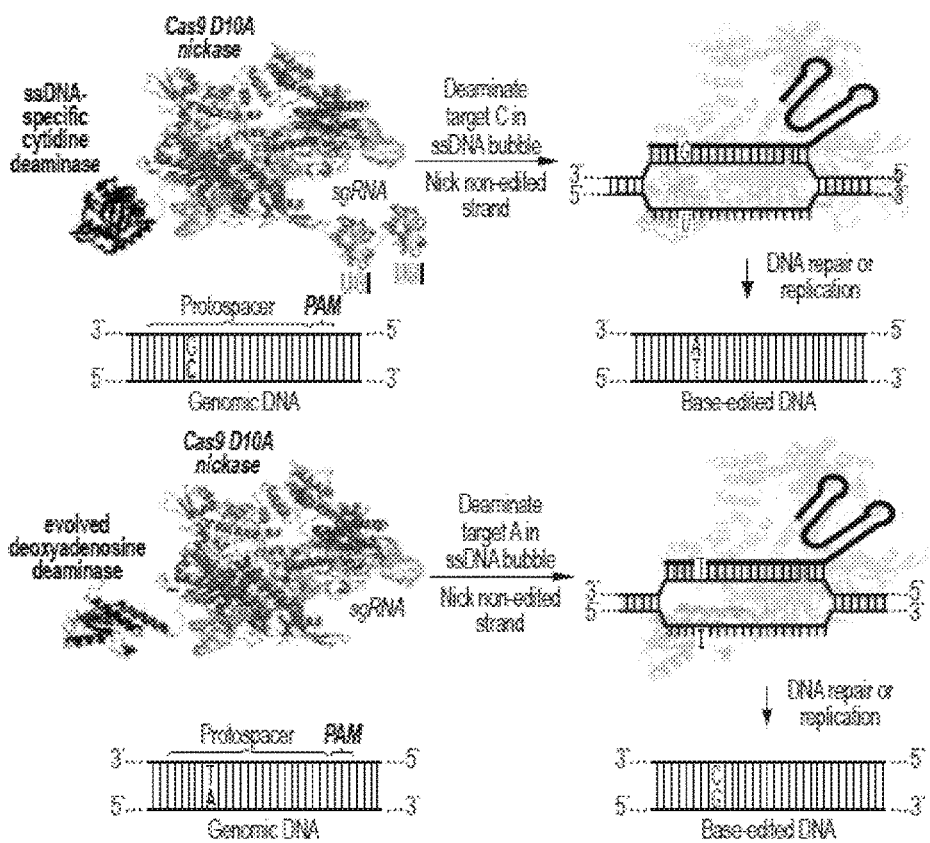
FIG. 1A
FIG. 1B
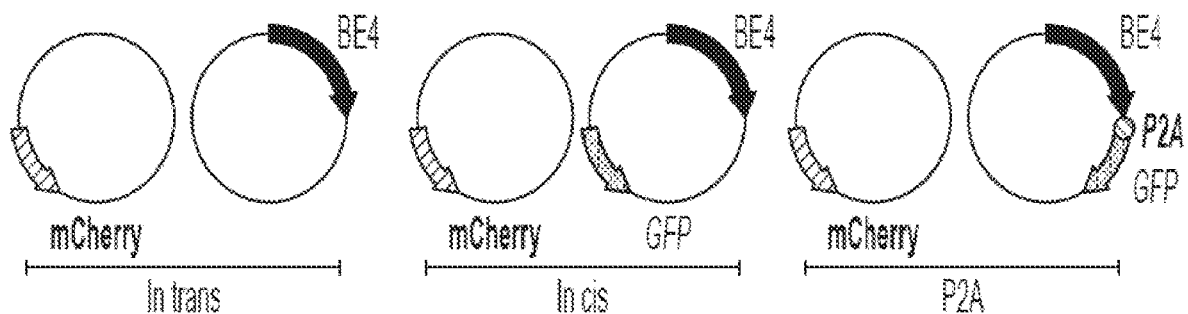
FIG. 1C

BE4 (IDT codons): SV40 vs. bis-bpNLS

| Site | p-value | Significance |
|---|---|---|
| HEK2 C4 | 0.0112 | * |
| HEK2 C6 | 0.0072 | ** |
| HEK3 C4 | 0.2838 | p>0.05 |
| HEK3 C5 | 0.3363 | p>0.05 |
| HEK4 C5 | 0.062 | p>0.05 |
| RNF2 C6 | 0.0217 | * |
| EMX1 C4 | 0.042 | * |
| EMX1 C5 | 0.0428 | * |

FIG. 5A bis-bpNLS: IDT codons vs. GenScript codons

| Site | p-value | Significance |
|---|---|---|
| HEK2 C4 | 0.0119 | * |
| HEK2 C6 | 0.0107 | ** |
| HEK3 C4 | 0.0194 | p>0.05 |
| HEK3 C5 | 0.0263 | p>0.05 |
| HEK4 C5 | 0.0176 | p>0.05 |
| RNF2 C6 | 0.0161 | * |
| EMX1 C4 | 0.0057 | * |
| EMX1 C5 | 0.0048 | * |

FIG. 5B

HEK3 (C5), BE4 vs. BE4max

| Plasmid dose (ng) | p-value | Significance |
|---|---|---|
| 750 | 0.008 | ** |
| 150 | 0.0531 | p>0.05 |
| 30 | 0.0017 | ** |
| 6 | 0.0013 | ** |
| 1.2 | 0.0081 | ** |
| 0.24 | 0.0849 | p>0.05 |
| 0.048 | 0.1434 | p>0.05 |
| 0.0096 | 0.5981 | p>0.05 |

RNF2 (C6), BE4 vs. BE4max

| Plasmid dose (ng) | p-value | Significance |
|---|---|---|
| 750 | 0.0005 | *** |
| 150 | 0.0126 | * |
| 30 | 0.0029 | ** |
| 6 | 0.0031 | ** |
| 1.2 | 0.002 | ** |
| 0.24 | 0.0283 | * |
| 0.048 | 0.0277 | * |
| 0.0096 | 0.3329 | p>0.05 |

EMX1 (C4), BE4 vs. BE4max

| Plasmid dose (ng) | p-value | Significance |
|---|---|---|
| 750 | 0.0013 | ** |
| 150 | 0.0006 | *** |
| 30 | 0.0024 | ** |
| 6 | 0.004 | ** |
| 1.2 | 0.0063 | ** |
| 0.24 | 0.0119 | * |
| 0.048 | 0.0019 | ** |
| 0.0096 | 0.1188 | p>0.05 |

FIG. 8A

HEK3 (C5), BE4 vs. ancBE4max

| Plasmid dose (ng) | p-value | Significance |
|---|---|---|
| 750 | 0.0013 | ** |
| 150 | 0.0125 | * |
| 30 | 0.001 | *** |
| 6 | < 0.0001 | **** |
| 1.2 | 0.0002 | *** |
| 0.24 | 0.0019 | ** |
| 0.048 | 0.0156 | * |
| 0.0096 | 0.2015 | p>0.05 |

RNF2 (C6), BE4 vs. ancBE4max

| Plasmid dose (ng) | p-value | Significance |
|---|---|---|
| 750 | 0.0187 | * |
| 150 | 0.0173 | * |
| 30 | 0.0012 | ** |
| 6 | 0.0005 | *** |
| 1.2 | 0.0019 | ** |
| 0.24 | 0.0039 | ** |
| 0.048 | 0.004 | ** |
| 0.0096 | 0.0115 | * |

EMX1 (C4), BE4 vs. ancBE4max

| Plasmid dose (ng) | p-value | Significance |
|---|---|---|
| 750 | 0.0013 | ** |
| 150 | 0.0006 | *** |
| 30 | 0.0037 | ** |
| 6 | 0.0007 | *** |
| 1.2 | 0.0026 | ** |
| 0.24 | 0.0026 | ** |
| 0.048 | 0.0004 | *** |
| 0.0096 | 0.0124 | * |

FIG. 8B

HEK3 (C5), BE4max vs. ancBE4max

| Plasmid dose (ng) | p-value | Significance |
|---|---|---|
| 750 | 0.0274 | * |
| 150 | 0.0387 | * |
| 30 | 0.0194 | * |
| 6 | 0.0268 | * |
| 1.2 | 0.0446 | * |
| 0.24 | 0.0161 | * |
| 0.048 | 0.0504 | p>0.05 |
| 0.0096 | 0.0454 | * |

RNF2 (C6), BE4max vs ancBE4max

| Plasmid dose (ng) | p-value | Significance |
|---|---|---|
| 750 | 0.8193 | p>0.05 |
| 150 | 0.9993 | p>0.05 |
| 30 | 0.5972 | p>0.05 |
| 6 | 0.5895 | p>0.05 |
| 1.2 | 0.4079 | p>0.05 |
| 0.24 | 0.0777 | p>0.05 |
| 0.048 | 0.0615 | p>0.05 |
| 0.0096 | 0.015 | * |

EMX1 (C4), BE4max vs ancBE4max

| Plasmid dose (ng) | p-value | Significance |
|---|---|---|
| 750 | 0.0608 | p>0.05 |
| 150 | 0.0551 | p>0.05 |
| 30 | 0.7657 | p>0.05 |
| 6 | 0.4013 | p>0.05 |
| 1.2 | 0.1746 | p>0.05 |
| 0.24 | 0.0314 | * |
| 0.048 | 0.0033 | ** |
| 0.0096 | 0.0216 | * |

FIG. 8C

HEK3, BE4

| Plasmid dose (ng) | % Indels | Stdev |
|---|---|---|
| 750 | 3.25 | 0.51 |
| 150 | 3.65 | 0.44 |
| 30 | 3.54 | 0.50 |
| 6 | 1.76 | 0.51 |
| 1.2 | 1.13 | 0.09 |
| 0.24 | 0.51 | 0.15 |
| 0.048 | 0.28 | 0.23 |
| 0.0096 | 0.47 | 0.48 |

RNF2, BE4

| Plasmid dose (ng) | % Indels | Stdev |
|---|---|---|
| 750 | 0.03 | 0.01 |
| 150 | 0.02 | 0.00 |
| 30 | 0.03 | 0.01 |
| 6 | 0.03 | 0.01 |
| 1.2 | 0.02 | 0.01 |
| 0.24 | 0.03 | 0.00 |
| 0.048 | 0.02 | 0.01 |
| 0.0096 | 0.02 | 0.00 |

EMX1, BE4

| Plasmid dose (ng) | % Indels | Stdev |
|---|---|---|
| 750 | 0.10 | 0.02 |
| 150 | 0.08 | 0.01 |
| 30 | 0.09 | 0.02 |
| 6 | 0.08 | 0.02 |
| 1.2 | 0.08 | 0.02 |
| 0.24 | 0.08 | 0.01 |
| 0.048 | 0.08 | 0.00 |
| 0.0096 | 0.07 | 0.02 |

FIG. 9

HEK3, BE4max

| Plasmid dose (ng) | % Indels | Stdev |
|---|---|---|
| 750 | 2.50 | 0.65 |
| 150 | 2.51 | 0.46 |
| 30 | 2.53 | 0.30 |
| 6 | 2.87 | 0.37 |
| 1.2 | 2.57 | 0.40 |
| 0.24 | 1.10 | 0.39 |
| 0.048 | 0.45 | 0.22 |
| 0.0096 | 0.17 | 0.11 |

RNF2, BE4max

| Plasmid dose (ng) | % Indels | Stdev |
|---|---|---|
| 750 | 0.03 | 0.01 |
| 150 | 0.03 | 0.01 |
| 30 | 0.03 | 0.01 |
| 6 | 0.04 | 0.01 |
| 1.2 | 0.03 | 0.01 |
| 0.24 | 0.03 | 0.00 |
| 0.048 | 0.02 | 0.00 |
| 0.0096 | 0.03 | 0.00 |

EMX1, BE4max

| Plasmid dose (ng) | % Indels | Stdev |
|---|---|---|
| 750 | 0.11 | 0.01 |
| 150 | 0.09 | 0.01 |
| 30 | 0.09 | 0.02 |
| 6 | 0.08 | 0.00 |
| 1.2 | 0.09 | 0.01 |
| 0.24 | 0.07 | 0.01 |
| 0.048 | 0.09 | 0.01 |
| 0.0096 | 0.10 | 0.02 |

FIG. 9 (cont.)

HEK3, ancBE4max

| Plasmid dose (ng) | % Indels | Stdev |
|---|---|---|
| 750 | 2.23 | 0.14 |
| 150 | 2.85 | 0.24 |
| 30 | 2.92 | 0.56 |
| 6 | 3.73 | 0.60 |
| 1.2 | 3.57 | 0.84 |
| 0.24 | 2.55 | 0.28 |
| 0.048 | 0.82 | 0.04 |
| 0.0096 | 0.13 | 0.03 |

RNF2, ancBE4max

| Plasmid dose (ng) | % Indels | Stdev |
|---|---|---|
| 750 | 0.03 | 0.00 |
| 150 | 0.05 | 0.01 |
| 30 | 0.04 | 0.00 |
| 6 | 0.03 | 0.01 |
| 1.2 | 0.03 | 0.01 |
| 0.24 | 0.03 | 0.00 |
| 0.048 | 0.03 | 0.00 |
| 0.0096 | 0.03 | 0.01 |

EMX1, ancBE4max

| Plasmid dose (ng) | % Indels | Stdev |
|---|---|---|
| 750 | 0.09 | 0.01 |
| 150 | 0.10 | 0.02 |
| 30 | 0.09 | 0.01 |
| 6 | 0.09 | 0.00 |
| 1.2 | 0.09 | 0.01 |
| 0.24 | 0.09 | 0.03 |
| 0.048 | 0.09 | 0.01 |
| 0.0096 | 0.09 | 0.00 |

FIG. 9 (cont.)

| ABE 7.10 vs. ABEmax | | |
|---|---|---|
| Plasmid dose (ng) | p-value | Significance |
| HEK2 A5 | 0.2012 | p>0.05 |
| HEK2 A7 | 0.6933 | p>0.05 |
| Site A5 | 0.0288 | * |
| Site 5 A5 | 0.0089 | ** |
| Site 5 A7 | 0.0086 | ** |
| Site 13 A5 | 0.001 | *** |
| Site 13 A7 | 0.001 | *** |
| Site 16 A4 | 0.0105 | * |
| Site 16 A5 | 0.0194 | * |
| Site 16 A7 | 0.0723 | p>0.05 |

FIG. 11A

Site 5 (A7), ABE vs. ABEmax

| Plasmid dose (ng) | p-value | Significance |
|---|---|---|
| 750 | 0.0019 | ** |
| 150 | 0.0002 | *** |
| 30 | <.0001 | **** |
| 6 | <.0001 | **** |
| 1.2 | 0.0005 | *** |
| 0.24 | 0.0577 | p>0.05 |
| 0.048 | 0.1378 | p>0.05 |
| 0.0096 | 0.093 | p>0.05 |

Site 13 (A5), ABE vs. ABEmax

| Plasmid dose (ng) | p-value | Significance |
|---|---|---|
| 750 | 0.0024 | ** |
| 150 | 0.0003 | *** |
| 30 | 0.0001 | *** |
| 6 | <.0001 | **** |
| 1.2 | 0.0033 | ** |
| 0.24 | 0.0623 | p>0.05 |
| 0.048 | 0.2684 | p>0.05 |
| 0.0096 | 0.8167 | p>0.05 |

Site 16 (A5), ABE vs ABEmax

| Plasmid dose (ng) | p-value | Significance |
|---|---|---|
| 750 | 0.0077 | ** |
| 150 | <.0001 | **** |
| 30 | <.0001 | **** |
| 6 | <.0001 | **** |
| 1.2 | 0.0008 | *** |
| 0.24 | 0.0289 | * |
| 0.048 | 0.1048 | p>0.05 |
| 0.0096 | 0.3917 | p>0.05 |

FIG. 11B

Site 5 (A7), ABE

| Plasmid dose (ng) | Indel % | Stdev |
|---|---|---|
| 750 | 0.20 | 0.14 |
| 150 | 0.15 | 0.08 |
| 30 | 0.07 | 0.02 |
| 6 | 0.05 | 0.01 |
| 1.2 | 0.04 | 0.00 |
| 0.24 | 0.03 | 0.01 |
| 0.048 | 0.03 | 0.00 |
| 0.0096 | 0.03 | 0.01 |

Site 13 (A5), ABE

| Plasmid dose (ng) | Indel % | Stdev |
|---|---|---|
| 750 | 0.25 | 0.15 |
| 150 | 0.15 | 0.07 |
| 30 | 0.10 | 0.03 |
| 6 | 0.04 | 0.02 |
| 1.2 | 0.02 | 0.00 |
| 0.24 | 0.02 | 0.00 |
| 0.048 | 0.02 | 0.01 |
| 0.0096 | 0.02 | 0.01 |

Site 16 (A5), ABE

| Plasmid dose (ng) | Indel % | Stdev |
|---|---|---|
| 750 | 0.15 | 0.03 |
| 150 | 0.22 | 0.03 |
| 30 | 0.10 | 0.03 |
| 6 | 0.06 | 0.01 |
| 1.2 | 0.06 | 0.02 |
| 0.24 | 0.03 | 0.02 |
| 0.048 | 0.03 | 0.01 |
| 0.0096 | 0.04 | 0.01 |

FIG. 12

Site 5 (A7), ABEmax

| Plasmid dose (ng) | Indel % | Stdev |
|---|---|---|
| 750 | 1.64 | 1.01 |
| 150 | 0.96 | 0.03 |
| 30 | 0.85 | 0.34 |
| 6 | 0.31 | 0.12 |
| 1.2 | 0.13 | 0.01 |
| 0.24 | 0.05 | 0.01 |
| 0.048 | 0.05 | 0.01 |
| 0.0096 | 0.04 | 0.01 |

Site 13 (A5), ABEmax

| Plasmid dose (ng) | Indel % | Stdev |
|---|---|---|
| 750 | 1.52 | 0.65 |
| 150 | 0.73 | 0.13 |
| 30 | 0.55 | 0.23 |
| 6 | 0.28 | 0.11 |
| 1.2 | 0.12 | 0.03 |
| 0.24 | 0.05 | 0.03 |
| 0.048 | 0.02 | 0.01 |
| 0.0096 | 0.02 | 0.01 |

Site 16 (A5), ABEmax

| Plasmid dose (ng) | Indel % | Stdev |
|---|---|---|
| 750 | 0.47 | 0.12 |
| 150 | 0.41 | 0.09 |
| 30 | 0.36 | 0.11 |
| 6 | 0.23 | 0.05 |
| 1.2 | 0.17 | 0.04 |
| 0.24 | 0.08 | 0.02 |
| 0.048 | 0.04 | 0.01 |
| 0.0096 | 0.04 | 0.01 |

BASE EDITORS AND USES THEREOF

RELATED APPLICATIONS

This application is a national stage filing under 35 U.S.C. § 371 of International PCT Application PCT/US2019/033848, filed May 23, 2019, which claims priority under 35 U.S.C. § 119(e) to U.S. Provisional Application U.S. Ser. No. 62/677,658, filed on May 29, 2018, and to U.S. Provisional Application U.S. Ser. No. 62/675,726, filed on May 23, 2018, each of which is incorporated herein by reference.

FEDERALLY SPONSORED RESEARCH

This invention was made with government support under Grant No. HR0011-17-2-0049 awarded by the Department of Defense, and Grant Nos. HG009490, EB022376, GM118062, CA014051, and GM095450 awarded by the National Institutes of Health. The government has certain rights in the invention.

REFERENCE TO AN ELECTRONIC SEQUENCE LISTING

The contents of the electronic sequence listing (B119570054US02-SEQ-JXV.txt; Size: 1,271,459 bytes; and Date of Creation: Nov. 20, 2020) is herein incorporated by reference in its entirety.

BACKGROUND OF THE INVENTION

Targeted editing of nucleic acid sequences, for example, the targeted cleavage or the targeted introduction of a specific modification into genomic DNA, is a highly promising approach for the study of gene function and also has the potential to provide new therapies for human genetic diseases, for example, those caused by point mutations. Point mutations represent the majority of known human genetic variants associated with disease (1). Developing robust methods to introduce and correct point mutations is therefore an important challenge to understand and treat diseases with a genetic component.

Engineered base editors have been recently developed (2, 3). Base editors are fusions of catalytically disabled Cas moiety and a nucleobase modification enzyme (e.g., natural or evolved nucleobase deaminases). In some cases, base editors may also include proteins that alter cellular DNA repair processes to increase the efficiency and stability of the resulting single-nucleotide change, e.g., a UGI domain (2, 3).

Two classes of base editors have been generally described to date: cytidine base editors convert target C·G base pairs to T·A base pairs, and adenine base editors convert A·T base pairs to G·C base pairs. Collectively, these two classes of base editors enable the targeted installation of all four transition mutations (C-to-T, G-to-A, A-to-G, and T-to-C), which collectively account for about 61% of known human pathogenic small nucleotide polymorphisms (SNPs) in the ClinVar database. In addition, base editors have been used widely in organisms ranging from prokaryotes to plants to amphibians to mammals, and have even been used to correct pathogenic mutations in human embryos (4-18).

However, the utility of base editing is limited by several constraints, including the PAM requirement imposed by the particular Cas moiety used (e.g., naturally occurring Cas9 from *S. pyogenes*, or a modified version thereof, or a homolog thereof), off-target base editing of non-target nucleotides nearby the desired editing site, the production of undesired edited genomic byproducts (e.g., indels), and overall low editing efficiencies.

The development of "next-generation" base editors has begun to address some of these limitations, including base editors with different or expanded PAM compatibilities (19-21), high fidelity base editors with reduced off-target activity (20, 22-25), base editors with narrower editing windows (normally ~5 nucleotides wide) (19), and a cytidine base editor (BE4) with reduced by-products (6).

Nevertheless, despite these recent advances, the efficiency of base editing by base editors varies widely by among other factors, cell type and target locus. Thus, there continues to be a significant need in the art for the development of base editors with improved editing efficiencies, and in particular, wherein the improvements are aimed to address those fundamental underlying biological aspects which restrict the genome editing efficiencies of base editor systems. The present disclosure provides improved base editors which overcome the problems in the art.

SUMMARY OF THE INVENTION

The instant specification provides for improved base editors which overcome deficiencies of those in art. In particular, the specification provides base editors with improved editing efficiencies, for example, wherein the improvements address underlying biological aspects that limit the efficiency of genome editing achieved by existing base editor systems, including, for example, improved expression and/or nuclear localization. In addition, the instant specification provides for nucleic acid molecules encoding and/or expressing the improved base editors disclosed herein, as well as vectors for cloning and/or expressing the improved base editors described herein, host cells comprising said nucleic acid molecules and cloning and/or expression vectors, and compositions for delivering and/or administering nucleic acid-based embodiments described herein. In addition, the disclosure provides for improved base editors as described herein, as well as compositions comprising said improved base editors. Still further, the present disclosure provides for methods of making the base editors, as well as methods of using the improved base editors or nucleic acid molecules encoding the improved base editors in applications including editing a nucleic acid molecule, e.g., a genome, with improved efficiency as compared to base editor that forms the state of the art. The specification also provides methods for efficiently editing a target nucleic acid molecule, e.g., a single nucleobase of a genome, with a base editing system described herein (e.g., in the form of an improved base editor protein as described herein or a vector encoding same) and conducting based editing. Still further, the specification provides therapeutic methods for treating a genetic disease and/or for altering or changing a genetic trait or condition by contacting a target nucleic acid molecule, e.g., a genome, with a base editing system (e.g., in the form of an isolated improved base editor protein or a vector encoding same) and conducting base editing to treat the genetic disease and/or change the genetic trait (e.g., eye color).

The present inventors have surprisingly discovered various ways to improve the efficiency of base editing by recognizing that the fraction of cells expressing active base editors, and/or the amount of functional base editor protein produced by each cell, constitutes restrictions on the efficiency of base editing. In particular, the inventors have surprisingly discovered that by (a) improving nuclear localization of the expressed base editor or component thereof to the nucleus, (b) optimizing codon usage of the sequence encoding the base editor or component thereof, and (c) enhancing the expression of the sequence encoding the base editor or component thereof, or a combination thereof, e.g., by ancestral protein reconstruction (ASR), significantly improves the editing efficiencies of previously known base editors, e.g., cytidine base editors. Ancestral protein reconstruction uses an alignment of known protein sequences, an evolutionary model, and a resulting phylogenetic tree to infer ancestral protein sequences at the nodes of the phylogeny. See, Harms, M. J. et al., "Evolutionary biochemistry: revealing the historical and physical causes of protein properties." *Nature reviews. Genetics* 14, 559-571 (2013); the entire contents of which are incorporated herein by reference. Indeed, ASR has been shown to improve the expression of a variety of proteins while retaining wild-type levels of biochemical activity. See, Wheeler, L. C., et al., "The thermostability and specificity of ancient proteins." *Curr Opin Struct Biol* 38, 37-43 (2016); Nguyen, V. et al., "Evolutionary drivers of thermoadaptation in enzyme catalysis." *Science* 355, 289-294 (2017); Wilson, C. et al. "Kinase dynamics. Using ancient protein kinases to unravel a modern cancer drug's mechanism." *Science* 347, 882-886 (2015); and Risso, V. A., et al., "Hyperstability and substrate promiscuity in laboratory resurrections of Precambrian beta-lactamases." *J Am Chem Soc* 135, 2899-2902 (2013); the entire contents of each of which are incorporated herein by reference.

These methods can be used to provide improved base editors that can be used to efficiently edit a nucleic acid molecule in a manner that is dramatically improved as compared to base editors known in the art. The improved base editors may be used to efficiently edit nucleic acid molecules, e.g., a genome, for example, by correcting a disease-causing point mutation.

Thus, in one aspect, the specification discloses a fusion protein comprising: (i) a nucleic acid programmable DNA binding protein (napDNAbp); (ii) a DNA effector domain; (iii) a first nuclear localization sequence; and (iv) a second nuclear localization sequence. In certain embodiments, the first nuclear localization sequence (NLS) and/or the second nuclear localization sequence is a bipartite nuclear localization sequence, for example a bipartite nuclear localization sequence that comprises the amino acid sequence of (SEQ ID NO: 1)
KRTADGSEFESPKKKRKV or (SEQ ID NO: 2)
KRTADGSEFEPKKKRKV.

Nuclear localization sequences may be at the N-terminus, and/or the C-terminus of the fusion proteins (e.g., base editors) provided herein. For example, any of the fusion proteins provided herein may have an N-terminal and a C-terminal NLS.

It should be appreciated that any of the fusion proteins provided herein contain a nucleic acid programmable DNA binding protein, such as a Cas9 domain, in order to bring the fusion protein in proximity to a target nucleic acid sequence (e.g., for the purposes of base editing). The nucleic acid programmable DNA binding protein may be a Cas9 domain, such as a Cas9 nickase domain. For example, the Cas9 nickase domain may be a Cas9 nickase that cuts a nucleic acid target strand of a nucleotide duplex, where the nucleotide target strand is the strand that binds a gRNA. As one example, the Cas9 domain comprises an amino acid sequence that is at least 80%, 85%, 90%, 95%, 98%, 99%, or 100% identical to the amino acid sequence of:

(SEQ ID NO: 3)
DKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFH

RLEESFLVEEDKKHERHPIFGNIVDEVAYHEKYPTIYHLRKKLVDSTDK

ADLRLIYLALAHMIKFRGHFLIEGDLNPDNSDVDKLFIQLVQTYNQLFE

ENPINASGVDAKAILSARLSKSRRLENLIAQLPGEKKNGLFGNLIALSL

GLTPNFKSNFDLAEDAKLQLSKDTYDDDLDNLLAQIGDQYADLFLAAKN

LSDAILLSDILRVNTEITKAPLSASMIKRYDEHHQDLTLLKALVRQQLP

EKYKEIFFDQSKNGYAGYIDGGASQEEFYKFIKPILEKMDGTEELLVKL

NREDLLRKQRTFDNGSIPHQIHLGELHAILRRQEDFYPFLKDNREKIEK

ILTFRIPYYVGPLARGNSRFAWMTRKSEETITPWNFEEVVDKGASAQSF

IERMTNFDKNLPNEKVLPKHSLLYEYFTVYNELTKVKYVTEGMRKPAFL

SGEQKKAIVDLLFKTNRKVTVKQLKEDYFKKIECFDSVEISGVEDRFNA

SLGTYHDLLKIIKDKDFLDNEENEDILEDIVLTLTLFEDREMIEERLKT

YAHLFDDKVMKQLKRRRYTGWGRLSRKLINGIRDKQSGKTILDFLKSDG

FANRNFMQLIHDDSLTFKEDIQKAQVSGQGDSLHEHIANLAGSPAIKKG

ILQTVKVVDELVKVMGRHKPENIVIEMARENQTTQKGQKNSRERMKRIE

EGIKELGSQILKEHPVENTQLQNEKLYLYYLQNGRDMYVDQELDINRLS

DYDVDHIVPQSFLKDDSIDNKVLTRSDKNRGKSDNVPSEEVVKKMKNYW

RQLLNAKLITQRKFDNLTKAERGGLSELDKAGFIKRQLVETRQITKHVA

QILDSRMNTKYDENDKLIREVKVITLKSKLVSDFRKDFQFYKVREINNY

HHAHDAYLNAVVGTALIKKYPKLESEFVYGDYKVYDVRKMIAKSEQEIG

KATAKYFFYSNIMNFFKTEITLANGEIRKRPLIETNGETGEIVWDKGRD

FATVRKVLSMPQVNIVKKTEVQTGGFSKESILPKRNSDKLIARKKDWDP

KKYGGFDSPTVAYSVLVVAKVEKGKSKKLKSVKELLGITIMERSSFEKN

PIDFLEAKGYKEVKKDLIIKLPKYSLFELENGRKRMLASAGELQKGNEL

ALPSKYVNFLYLASHYEKLKGSPEDNEQKQLFVEQHKHYLDEIIEQISE

FSKRVILADANLDKVLSAYNKHRDKPIREQAENIIHLFTLTNLGAPAAF

KYFDTTIDRKRYTSTKEVLDATLIHQSITGLYETRIDLSQLGGD.

In some aspects, the fusion proteins provided herein include an effector domain that is capable of making a modification to a nucleic acid (e.g., DNA). For example, the DNA effector domain may be a deaminase domain, such as a cytidine deaminase domain or an adenosine deaminase domain. In certain embodiments, the deaminase domain is a cytidine deaminase domain, such as an APOBEC or AID cytidine deaminase. For base editing proteins that are capable of deaminating a cytidine to a uridine, e.g., to induce a C to T mutation in a DNA molecule, the cytidine deaminase can be a deaminase from the apolipoprotein B mRNA-editing complex (APOBEC) family deaminase. For example, the cytidine deaminase may comprise an APOBEC cytidine deaminase having an amino acid sequence that is at least 80%, 85%, 90%, 95%, 98%, 99%, or 100% identical to the amino acid sequence of:

(SEQ ID NO: 4)
SSETGPVAVDPTLRRRIEPHEFEVFFDPRELRKETCLLYEINWGGRHSI

WRHTSQNTNKHVEVNFIEKFTTERYFCPNTRCSITWFLSWSPCGECSRA

ITEFLSRYPHVTLFIYIARLYHHADPRNRQGLRDLISSGVTIQIMTEQE

SGYCWRNFVNYSPSNEAHWPRYPHLWVRLYVLELYCIILGLPPCLNILR

RKQPQLTFFTIALQSCHYQRLPPHILWATGLK.

The cytidine deaminase may also be an ancestral cytidine deaminase, such as any of the Anc689, Anc687, Anc686, Anc655, or Anc733 ancestral cytidine deaminases provided herein (e.g., any one of SEQ ID NOs: 5-9)

The fusion proteins provided herein, e.g., those that comprise two or more NLSs, may further include one or more Uracil-DNA glycosylase inhibitor (UGI) domains, which are capable of inhibiting Uracil-DNA glycosylase, thereby improving base editing efficiency of C to T base editor proteins. As one example, any of the fusion proteins provided herein comprise an amino acid sequence that is at least 80%, 85%, 90%, 95%, 98%, 99%, or 100% identical to the amino acid sequence of (SEQ ID NO: 108)
TNLSDIIEKETGKQLVIQESILMLPEEVEEVIGNKPESDILVHTAYDES
TDENVMLLTSDAPEYKPWALVIQDSNGENKIKML.

It should be appreciated that the fusion proteins provided herein may be arranged in any configuration, for example, the fusion protein may have the structure: NH$_2$-[first nuclear localization sequence]-[cytidine deaminase domain]-[Cas9 domain]-[first UGI domain]-[second UGI domain]-[second nuclear localization sequence]-COOH, and each instance of "-" comprises an optional linker. Linker sequences that may be used to link certain domains of the fusion protein are provided herein and may be modified to enhance the properties of the fusion proteins herein, such as base editing efficiency or modulating a base editing window.

In some aspects, any of the fusion proteins provided herein have an effector domain that includes an adenosine deaminase. Such fusion proteins may be used as adenosine base editing proteins, e.g., for generating an A to G mutation in a DNA molecule. Accordingly, in certain embodiments, the effector domain comprises an adenosine deaminase, for example an adenosine deaminase that deaminates an adenine in DNA. Adenosine deaminases that deaminate adenine in DNA have been described previously, for example in PCT/US2017/045381 (published as WO 2018/027078).

In certain embodiments, the adenosine deaminase comprises an amino acid sequence that is at least 80%, 85%, 90%, 95%, 98%, or 99% identical to the amino acid sequence of SEQ ID NO: 15, and includes one or more substitutions that confers the ability of the adenosine deaminase to deaminate adenine in DNA. For example, In certain embodiments, said one or more substitutions comprise a group of substitutions selected from the groups of substitutions consisting of: (i) W23L, H36L, P48A, R51L, L84F, A106V, D108N, H123Y, A142N, S146C, D147Y, R152P, E155V, I156F, and K157N; (ii) W23R, H36L, P48A, R51L, L84F, A106V, D108N, H123Y, S146C, D147Y, R152P, E155V, I156F, and K157N; (iii) H36L, P48S, R51L, L84F, A106V, D108N, H123Y, A142N, S146C, D147Y, E155V, I156F, and K157N; (iv) H36L, P48S, R51L, L84F, A106V, D108N, H123Y, S146C, D147Y, E155V, I156F, and K157N; (v) H36L, R51L, L84F, A106V, D108N, H123Y, S146C, D147Y, E155V, I156F, and K157N; (vi) L84F, A106V, D108N, H123Y, D147Y, E155V, and I156F; (vii) A106V, D108N, D147Y, and E155V; (viii) A106V and D108N; and (ix) D108N; of the amino acid sequence of SEQ ID NO: 15. It should be appreciated the fusion proteins comprising an adenosine deaminase may further comprise a second adenosine deaminase, e.g., a TadA adenosine deaminase as set forth in SEQ ID NO: 15. Without wishing to be bound by any particular theory, dimerization of adenosine deaminase domains may improve base editing efficiency of any of the fusion proteins provided herein. As one example, the fusion protein may comprises the structure: NH$_2$-[first nuclear localization sequence]-[first adenosine deaminase]-[second adenosine deaminase]-[Cas9 domain]-[second nuclear localization sequence]-COOH, and each instance of "-" comprises an optional linker.

Some aspects of the disclosure provide nucleic acid sequences, e.g., DNA sequences encoding any of the fusion proteins, fusion protein domains (e.g., effector domains, napDNAbps, UGI domains) or linkers provided herein. In some embodiments, the DNA sequences are sequence optimized for expression in one or more cell types. For example, the DNA sequences may be optimized for expression in a mammalian cell (e.g., a HEK 293T cell). It should be appreciated that optimizing the codon usage of base editor constructs can greatly improve base editing efficiency. The DNA sequences may be codon optimized for expressing in a mammalian cell using Integrated DNA Technologies (IDT), GeneArt, Coller, and GenScript. Preferably, DNA sequences are codon optimized for expressing in a mammalian cell using GenScript. As one example In one aspect, the specification discloses a complex comprising any one of the presently disclosed fusion proteins and an RNA bound to the napDNAbp. In certain embodiments, the RNA is a guide RNA (gRNA). In certain embodiments, the RNA is a single guide RNA (sgRNA). In certain embodiments, the RNA comprises a nucleic acid sequence that targets SCN9a, MPDU1, or HBG In one aspect, the specification discloses a method comprising contacting a nucleic acid (e.g., double stranded DNA) molecule with any of the presently disclosed complexes. The DNA may include a target sequence associated with a disease or disorder that may be corrected by contacting the complex with the DNA. In certain embodiments, the target sequence comprises a point mutation associated with a disease or disorder. For example, the target sequence may have a T to C point mutation associated with a disease or disorder, where the deamination of the mutant C base results in a sequence that is not associated with a disease or disorder. In certain embodiments, the target sequence comprises a G to A point mutation associated with a disease or disorder, where the deamination of the mutant A base results in a sequence that is not associated with a disease or disorder. The methods provided herein can be performed in vitro, such as in cell culture, or in vivo, such as in a subject.

In certain embodiments, the subject has been diagnosed with a disease or disorder. In certain embodiments, the disease or disorder is selected from the group consisting of congenital disorder of glycosylation type 1f, familial erythromyalgia, paroxysmal extreme pain disorder, chronic insensitivity to pain, sickle cell anemia, and β-thalassemia. In certain embodiments, the disease or disorder is associated with a point mutation in a MDPU1 gene, a SCN9a gene or an HBG1 and/or an HBG2 gene.

In one aspect, the specification discloses pharmaceutical compositions comprising any of the presently disclosed fusion proteins, complexes, nucleic acids, and/or vectors. In certain embodiments, the pharmaceutical composition further comprises a pharmaceutically acceptable excipient, a lipid (e.g., a cationic lipid), and/or a polymer.

In one aspect, the disclosure provides ancestral cytidine deaminases, such as Anc689, Anc687 Anc686, Anc655, and Anc733. In another aspect, the specification provides ancestral cytidine deaminases that comprise an amino acid sequence that is at least 80%, 85%, 90%, 95%, 98%, or 99% identical to the amino acid sequence of any one of SEQ ID NOs: 5-9. In other embodiments, the ancestral cytidine deaminases comprise an amino acid sequence set forth in any one of SEQ ID NOs: 5-9. The application also provides for DNA sequences that encode such ancestral cytidine deaminases.

It should be appreciated that the foregoing concepts, and additional concepts discussed below, may be arranged in any suitable combination, as the present disclosure is not limited in this respect. Further, other advantages and novel features of the present disclosure will become apparent from the following detailed description of various non-limiting embodiments when considered in conjunction with the accompanying figures.

BRIEF DESCRIPTION OF THE DRAWINGS

FIGS. 1A-1E. Probing the factors that limit base editing efficiency in human cells. (FIG. 1A), BE4 (left) and ABE (right) induce the deamination of target C or target A nucleotides. They also nick the non-edited strand to direct DNA repair processes to replace that strand using the deaminated C (uracil, U) or the deaminated A (inosine, I) as a template. The result is BE4-mediated conversion of a target C·G base pair to a T·A base pair, and ABE-mediated conversion of a target A·T base pair to a G·C base pair. (FIG. 1B) Base pair changes required to correct pathogenic SNPs in the ClinVar database. The "1" wedge (47%) require conversion of the type mediated by ABE, while the "2" wedge (14%) require conversion of the type mediated by BE4. (FIG. 1C) Three base editor and fluorescent protein construct pairs used to elucidate the relationship between base editor expression and editing efficiency in human cells. All samples were transfected with an mCherry expression plasmid as a transfection control. In addition, cells were transfected with a BE4 expression plasmid ("in trans"), with a plasmid co-expressing both BE4 and GFP on separate promoters ("in cis"), or with a plasmid expressing BE4-P2A-GFP, where P2A is a self-cleaving peptide that liberates free BE4 and free GFP during translation of a single mRNA ("P2A"). (FIG. 1D) Percent mCherry-positive or GFP-positive HEK293T cells 3 days after transfection of the construct pairs in (FIG. 1C). (FIG. 1E) Target C·G-to-T·A editing efficiency for unsorted HEK293T cells and sorted populations of HEK293T cells. The sorted in trans cells were mCherry-positive, while the sorted in cis and P2A cells were dual mCherry-positive and GFP-positive. Values and error bars in (FIG. 1D) and (FIG. 1E) represent the mean and standard deviation of three biological replicates 3 days after transfection.

(FIG. 2A) BE4 architecture and effects of six NLS configurations on BE4 base editing efficiency at five endogenous genomic loci in HEK293T cells. (FIG. 2B) Effects of five codon usage methods on base editing efficiency of bis-bpNLS-BE4 at five endogenous genomic loci in HEK293T cells. Codon optimizations are as follows: IDT, Integrated DNA Technologies; J C, Jeff Coller; G A, GeneArt; G S, GenScript; IDT-GS, IDT APOBEC+GenScript Cas9 nickase. (FIG. 2C) Phylogenetic tree for ancestral APOBEC reconstruction. Numbered dots denote ancestral APOBEC sequences assayed for base editing activity in (FIG. 2D). (FIG. 2D) Base editing activity of bis-bpNLS-BE4 constructs with GenScript codon optimization using the ancestral APOBEC domains in (FIG. 2C) at five endogenous genomic loci in HEK293T cells. (FIG. 2E) Comparison of BE4, bis-bpNLS-BE4 with GenScript codons (BE4 max), and bis-bpNLS-BE4 with ancestral Anc689 APOBEC and GenScript codons (AncBE4 max) at three endogenous genomic loci in HEK293T cells across eight different plasmid doses. Values and error bars in (FIGS. 2A-2B) and (FIGS. 2D-2E) represent the mean and standard deviation of three biological replicates 3 days after transfection, except two replicates were used for wild-type rat APOBEC1 in (FIG. 2D).

(FIG. 3A) ABE architecture, effects of NLS configuration (SV40 versus bis-bpNLS), and effects of codon usage (IDT versus GenScript) on ABE base editing efficiency at five endogenous genomic loci in HEK293T cells. BP: bis-bpNLS; GS: GenScript codon usage. (FIG. 3B) Comparison of previously reported ABE 7.10, bis-bpNLS-ABE with IDT codons, and bis-bpNLS-ABE with GenScript codons (ABEmax) at three endogenous genomic loci in HEK293T cells across eight different plasmid doses. Values and error bars represent the mean and standard deviation of three biological replicates 3 days after transfection, except two biological replicates were obtained for the 750 ng dose of bis-bpNLS ABE 7.10 at Site 5 and Site 13 in FIG. 3B.

(FIG. 4A) C·G to T·A editing outcomes for the correction of the Leu119Pro T>C mutation in MDPU1 driving congenital disorder of glycosylation (CDG) type 1f by BE4, BE4 max, or AncBE4 max, in unsorted or sorted patient-derived fibroblasts. Among sorted cells, BE4 samples were sorted for mCherry-positive cells, while BE4 max-P2A-GFP and AncBE4 max-P2A-GFP samples were sorted for GFP-positive cells. All other C·G to T·A edits in the editing window are silent and are not shown. (FIG. 4B) C·G to T·A editing outcomes for editing the 3' splice acceptor in intron 6 of SCN9a in mouse N2a cells, unsorted or sorted as described in (FIG. 4A). (FIG. 4C) A·T to G·C editing outcomes for the installation of activating mutations at protospacer positions A5 and A8 (−116 A to G and −113 A to G) in the Bcl11a binding sites of both HBG1 and HBG2 fetal hemoglobin promoters by ABE 7.10 or ABEmax in unsorted or sorted HEK293T cells. Among sorted cells, ABE samples were sorted for mCherry-positive cells, and ABEmax-P2A-GFP samples were sorted for GFP-positive cells. (FIG. 4D) A·T to G·C editing outcomes for the installation of a mutation at protospacer position A3 (HBG-175 T to C) thought to be the strongest SNP known to mediate the activation of fetal hemoglobin expression[48] by ABE 7.10 or ABEmax in HEK293T cells, unsorted or sorted as described in (FIG. 4C). Values and error bars represent the mean and standard deviation of three biological replicates 3 days after transfection, except two biological replicates were obtained for AncBE4 max for the SCN9a target.

FIGS. 5A-5B. Unpaired two-sided t-test p-values for NLS and codon optimizations. (FIG. 5A) Unpaired two-sided t-test p-values for previously reported BE4 (C-terminal SV40 NLS, IDT codons) compared to bis-bpNLS BE4 (IDT codons) at all Cs within the activity window across five endogenous genomic loci in HEK293T cells transfected with 750 ng of base editor plasmid and 250 ng of sgRNA plasmid. (FIG. 5B) Unpaired two-sided t-test p-values for BE4 bis-bpNLS using IDE codons compared to GenScript codons at all Cs within the activity window across five endogenous genomic loci in HEK293T cells transfected with 750 ng of base editor plasmid and 250 ng of sgRNA plasmid. *$p \leq 0.05$; **$p \leq 0.01$.

(FIG. 6A) C·G-to-T·A base editing outcomes of bis-bpNLS BE4 variants using full-length GenScript codon optimization (BE4 max) compared to chimeric constructs in which the APOBEC1 and Cas9 nickase components are constructed with different codon usages in HEK293T cells. Chimeras include (APOBEC1-Cas9 nickase): GenScript-IDT, GenScript-Jin Soo Kim, IDT-Jin Soo Kim. (FIG. 6B) Comparison of BE4 max and bis-bpNLS BE4 with chimeric IDT-GenScript codon usage at three endogenous genomic loci in HEK293T cells across eight different plasmid doses. Values and error bars represent the mean and standard deviation of three biological replicates 3 days after transfection.

FIGS. 8A-8C. Unpaired two-sided t-test p-values for BE4, BE4 max, and AncBE4 max editing at three genomic loci. (FIG. 8A) Unpaired two-sided t-test p-values for BE4 compared to BE4 max at HEK3 (C5), RNF2 (C6), and EMX1 (C4) across eight different base editor plasmid doses in HEK293T cells. (FIG. 8B) Unpaired two-sided t-test p-values for BE4 compared to AncBE4 max at HEK3 (C5), RNF2 (C6), and EMX1 (C4) across eight different base editor plasmid doses in HEK293T cells. (FIG. 8C) Unpaired two-sided t-test p-values for BE4 max compared to AncBE4 max at HEK3 (C5), RNF2 (C6), and EMX1 (C4) across eight different base editor plasmid doses in HEK293T cells. *$p \leq 0.05$; $p \leq 0.01$; *$p \leq 0.001$; ****$p \leq 0.0001$.

FIG. 9. Indel frequencies for BE4, BE4 max, and AncBE4 at three genomic loci. Indel frequencies are shown for BE4, BE4 max, and AncBE4 max at HEK3, RNF2, and EMX1 sites across eight different plasmid doses in HEK293T cells. % Indel and Stdev values represent the mean and standard deviation of three biological replicates 3 days after transfection.

(FIG. 10A) BE4 max and AncBE4 max result in 3.7- and 5.2-fold higher mRNA levels, respectively, than BE4 in HEK293T cells 3 days after base editor and guide RNA plasmid transfection as determined by qRT-PCR. Base editor mRNA levels were normalized to β-actin levels by ΔΔCt. Normalized values were adjusted for transfection efficiency as determined by qPCR amplification of the bGH terminator sequence present on BE4 plasmids. (FIG. 10B) Western blot of C-terminal HA-tagged BE4, BE4 max, and AncBE4 max in HEK293T cells 3 days after plasmid transfection, visualizing with anti-HA (top) or anti-actin (bottom) antibodies. The mock sample is cells transfected with guide RNA plasmid alone. (FIG. 10C) BE4 max-P2A-GFP and AncBE4 max-P2A-GFP show higher GFP and mCherry double-positive cell populations compared to BE4-P2A-GFP for three genomic loci 3 days after transfection. (FIG. 10D) C·G-to-T·A base editing outcomes for GFP and mCherry dual-positive cells expressing BE4-P2A-GFP, BE4 max-P2A-GFP, and AncBE4 max-P2A-GFP at three genomic loci tested. Values and error bars in (FIG. 10A), (FIG. 10C), and (FIG. 10D) represent the mean and standard deviation of three biological replicates 3 days after transfection.

FIGS. 11A-11B. Unpaired two-sided t-test p-values editing by ABE and ABEmax. (FIG. 11A) Unpaired two-sided t-test p-values comparing ABE and ABEmax at five genomic loci tested with 750 ng of ABE editor and 250 ng gRNA in HEK293T cells. (FIG. 11B) Unpaired two-sided t-test p-values for ABE and ABEmax at Site 5 (A7), Site 13 (A5), and Site 16 (A5) across eight different plasmid doses in HEK293T cells. *$p \leq 0.05$; $p \leq 0.01$; *$p \leq 0.001$; ****$p \leq 0.0001$.

FIG. 12. Indel frequencies for ABE versus ABEmax at three genomic loci. Indel frequencies are shown for ABE and ABEmax at Site 5, Site 13, and Site 16 across eight different plasmid doses in HEK293T cells. % Indel and Stdev values represent the mean and standard deviation of three biological replicates 3 days after transfection.

FIG. 13. C·G-to-T·A base editing of the 3' splice acceptor of SCN9a intron 6 in sorted N2a cells. N2a cells were nucleofected with plasmids encoding AncBE4 max-P2A-GFP and the targeting sgRNA. Following a 3 day incubation, GFP-positive cells were isolated by FACS and analyzed by HTS. The protospacer of the non-transcribed strand is shown here; C7 corresponds to +1 G and C8 corresponds to −1 G of the 3' splice acceptor. The PAM is shown as the last GGG in the sequence. The sequence corresponds to SEQ ID NO: 71.

(FIG. 14A) Congenital disorder of glycosylation type 1f fibroblasts were nucleofected with a plasmid encoding mCherry, a plasmid encoding the targeting sgRNA, and a plasmid encoding BE4, BE4 max-P2A-GFP, or AncBE4 max-P2A-GFP, then sorted after 3 days. (FIG. 14B) N2a cells were transfected with a plasmid encoding mCherry, a plasmid encoding the targeting sgRNA, and a plasmid encoding BE4, BE4 max-P2A-GFP, or AncBE4 max-P2A-GFP, then sorted after 3 days. (FIG. 14C) HEK293T cells were transfected with a plasmid encoding mCherry, a plasmid encoding the targeting sgRNA, and a plasmid encoding ABE or ABEmax-P2A-GFP, then sorted after 3 days. Values and error bars represent the mean and standard deviation of three biological replicates 3 days after transfection, except two biological replicates were used for AncBE4 max-P2A-GFP in N2a cells.

DEFINITIONS

Figure 1D:
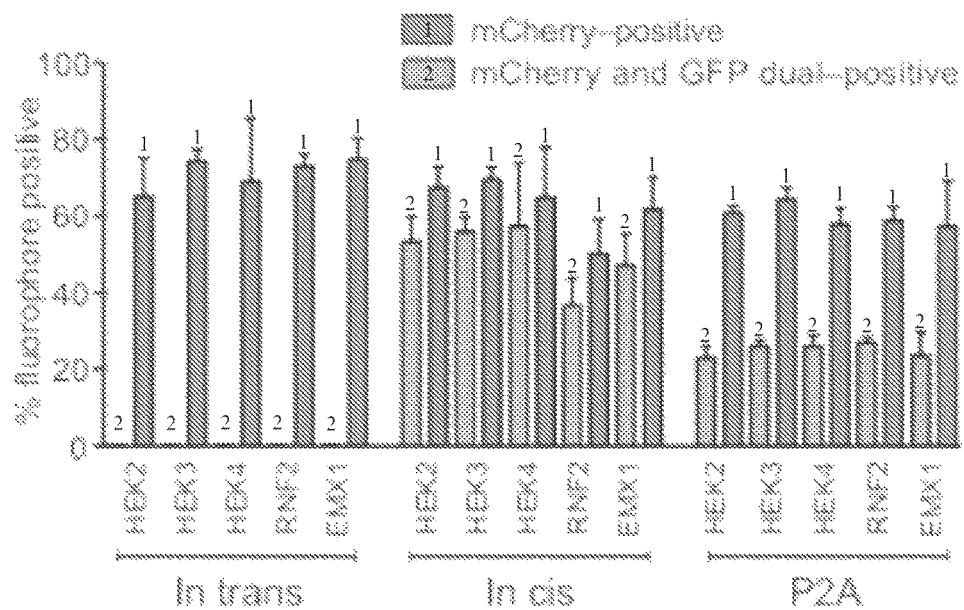

As used herein and in the claims, the singular forms "a," "an," and "the" include the singular and the plural reference unless the context clearly indicates otherwise. Thus, for example, a reference to "an agent" includes a single agent and a plurality of such agents.

Adenosine Deaminase

As used herein, an "adenosine deaminase" is an enzyme that catalyzes the deamination of adenosine, converting it to the nucleoside hypoxanthine. Under standard Watson-Crick hydrogen bond pairing, an adenosine base hydrogen bonds to a thymine base (or a uracil in case of RNA). When adenine is converted to hypoxanthine, the hypoxanthine undergoes hydrogen bond pairing with cytosine. Thus, a conversion of "A" to hypoxanthine by adenosine deaminase will cause the insertion of "C" instead of a "T" during cellular repair and/or replication processes. Since the cytosine "C" pairs with guanine "G", the adenosine deaminase in coordination with DNA replication causes the conversion of an A·T pairing to a C·G pairing in the double-stranded DNA molecule.

Ancestral Sequence Reconstruction (ASR)

Ancestral sequence reconstruction (ASR) is the process of analyzing modern sequences within an evolutionary/phylogenetic context to infer the ancestral sequences at particular nodes of a tree using an ASR algorithm. ASR algorithms are known in the art.

Base Editing

Base editing is a genome editing technology that involves the conversion of a specific nucleic acid base into another at a targeted genomic locus. In certain aspects, this can be achieved without requiring double-stranded DNA breaks (DSB). Since many genetic diseases arise from point mutations, this technology has important implications in the study of human health and disease.

To date, other genome editing techniques, including CRISPR-based systems, begin with the introduction of a DSB at a locus of interest. Subsequently, cellular DNA repair enzymes mend the break, commonly resulting in random insertions or deletions (indels) of bases at the site of the DSB. However, when the introduction or correction of a point mutation at a target locus is desired rather than stochastic disruption of the entire gene, these genome editing techniques are unsuitable, as correction rates are low (e.g., typically 0.1% to 5%), with the major genome editing products being indels. In order to increase the efficiency of gene correction without simultaneously introducing random indels, the present inventors previously modified the CRISPR/Cas9 system to directly convert one DNA base into another without DSB formation.

Base Editors

The term "base editors (BEs)" or "nucleobase editors (NBEs)" or as used herein, refers to the improved Cas-fusion proteins described herein. In some embodiments, the fusion protein comprises a nuclease-inactive Cas9 (dCas9) fused to a deaminase which still binds DNA in a guide RNA-programmed manner via the formation of an R-loop, but does not cleave the DNA backbone. For example, the dCas9 of the fusion protein can comprise a D10A and a H840A mutation (which renders Cas9 capable of cleaving only one strand of a nucleic acid duplex) as described in PCT/US2016/058344 (published as WO 2017/070632), which is incorporated herein by reference in its entirety. In some embodiments, the fusion protein comprises a Cas9 nickase fused to a deaminase, e.g., a cytidine deaminase (rAPOBEC1) which converts a DNA base cytosine to uracil. One such base editor is referred to as "BE1" in the literature. In some embodiments, the fusion protein comprises a nuclease-inactive Cas9 fused to a deaminase and further fused to a UGI domain (uracil DNA glycosylase inhibitor, which prevents the subsequent U:G mismatch from being repaired back to a C:G base pair). One such base editor is referred to as "BE2" in the literature. In other embodiments, to improve base editing efficiency, the catalytic His residue at position 840 in the Cas9 HNH domain of BE2 can be restore (resulting in "BE3" as described in the literature), which nicks only the non-edited strand, simulating newly synthesized DNA and leading to the desired U:A product. In other embodiments, the dCas9 is any dCas9 disclosed or described in PCT/US2017/045381 (published as WO 2018/027078), which is incorporated herein by reference in its entirety. The terms "nucleobase editors (NBEs)" and "base editors (BEs)" may be used interchangeably. The term "base editors" encompasses any base editor known or described in the art at the time of this filing, but also the improved base editors described herein. The base editors known in the state of the art which may be modified by the methods and strategies described herein to improve editing efficiency include, for example, BE1, BE2, BE3, or BE4.

Cas9 or Cas9 Moiety

The term "Cas9" or "Cas9 nuclease" or "Cas9 moiety" refers to a CRISPR associated protein 9, or functional fragment thereof, and embraces any naturally occurring Cas9 from any organism, any naturally-occurring Cas9 equivalent or functional fragment thereof, any Cas9 homolog, ortholog, or paralog from any organism, and any mutant or variant of a Cas9, naturally-occurring or engineered. More broadly, a Cas9 is a type of "RNA-programmable nuclease" or "RNA-guided nuclease" or more broadly a type of "nucleic acid programmable DNA binding protein (napDNAbp)". The term Cas9 is not meant to be particularly limiting and may be referred to as a "Cas9 or equivalent." Exemplary Cas9 proteins are further described herein and/or are described in the art and are incorporated herein by reference. The present disclosure is unlimited with regard to the particular Cas9 that is employed in the improved base editors of the invention.

dCas9

As used herein, the term "dCas9" refers to a nuclease-inactive Cas9 or nuclease-dead Cas9, or a functional fragment thereof, and embraces any naturally occurring dCas9 from any organism, any naturally-occurring dCas9 equivalent or functional fragment thereof, any dCas9 homolog, ortholog, or paralog from any organism, and any mutant or variant of a dCas9, naturally-occurring or engineered. The term dCas9 is not meant to be particularly limiting and may be referred to as a "dCas9 or equivalent." Exemplary dCas9 proteins and method for making dCas9 proteins are further described herein and/or are described in the art and are incorporated herein by reference.

Cytidine Deaminase

As used herein, a "cytidine deaminase" encoded by the CDA gene is an enzyme that catalyzes the removal of an amine group from cytidine (i.e., the base cytosine when attached to a ribose ring) to uridine (C to U) and deoxycytidine to deoxyuridine (C to U). A non-limiting example of a cytidine deaminase is APOBEC1. Under standard Watson-Crick hydrogen bond pairing, a cytosine base hydrogen bonds to a guanine base. When cytidine is converted to uridine (or deoxycytidine is converted to deoxyuridine), the uridine (or the uracil base of uridine) undergoes hydrogen bond pairing with the base adenine. Thus, a conversion of "C" to uridine ("U") by cytidine deaminase will cause the insertion of "A" instead of a "G" during cellular repair and/or replication processes. Since the adenine "A" pairs with thymine "T", the cytidine deaminase in coordination with DNA replication causes the conversion of an C·G pairing to a T·A pairing in the double-stranded DNA molecule.

CRISPR

CRISPR is a family of DNA sequences (i.e., CRISPR clusters) in bacteria and archaea that represent snippets of prior infections by a virus that have invaded the prokaryote. The snippets of DNA are used by the prokaryotic cell to detect and destroy DNA from subsequent attacks by similar viruses and effectively compose, along with an array of CRISPR-associated proteins (including Cas9 and homologs thereof) and CRISPR-associated RNA, a prokaryotic immune defense system. In nature, CRISPR clusters are transcribed and processed into CRISPR RNA (crRNA). In certain types of CRISPR systems (e.g., type II CRISPR systems), correct processing of pre-crRNA requires a trans-encoded small RNA (tracrRNA), endogenous ribonuclease 3 (rnc) and a Cas9 protein. The tracrRNA serves as a guide for ribonuclease 3-aided processing of pre-crRNA. Subsequently, Cas9/crRNA/tracrRNA endonucleolytically cleaves linear or circular dsDNA target complementary to the RNA. Specifically, the target strand not complementary to crRNA is first cut endonucleolytically, then trimmed 3'-5' exonucleolytically. In nature, DNA-binding and cleavage typically requires protein and both RNAs. However, single guide RNAs ("sgRNA", or simply "gNRA") can be engineered so as to incorporate aspects of both the crRNA and tracrRNA into a single RNA species—the guide RNA. See, e.g., Jinek M., Chylinski K., Fonfara I., Hauer M., Doudna J. A., Charpentier E. *Science* 337:816-821(2012), the entire contents of which is hereby incorporated by reference. Cas9 recognizes a short motif in the CRISPR repeat sequences (the PAM or protospacer adjacent motif) to help distinguish self versus non-self. CRISPR biology, as well as Cas9 nuclease sequences and structures are well known to those of skill in the art (see, e.g., "Complete genome sequence of an M1 strain of *Streptococcus pyogenes*." Ferretti et al., J. J., McShan W. M., Ajdic D. J., Savic D. J., Savic G., Lyon K., Primeaux C., Sezate S., Suvorov A. N., Kenton S., Lai H. S., Lin S. P., Qian Y., Jia H. G., Najar F. Z., Ren Q., Zhu H., Song L., White J., Yuan X., Clifton S. W., Roe B. A., McLaughlin R. E., Proc. Natl. Acad. Sci. U.S.A. 98:4658-4663(2001); "CRISPR RNA maturation by trans-encoded small RNA and host factor RNase III." Deltcheva E., Chylinski K., Sharma C. M., Gonzales K., Chao Y., Pirzada Z. A., Eckert M. R., Vogel J., Charpentier E., Nature 471:602-607(2011); and "A programmable dual-RNA-guided DNA endonuclease in adaptive bacterial immunity." Jinek M., Chylinski K., Fonfara I., Hauer M., Doudna J. A., Charpentier E. *Science* 337:816-821(2012), the entire contents of each of which are incorporated by reference). Cas9 orthologs have been described in various species, including, but not limited to, *S. pyogenes* and *S. thermophilus*. Additional suitable Cas9 nucleases and sequences will be apparent to those of skill in the art based on this disclosure, and such Cas9 nucleases and sequences include Cas9 sequences from the organisms and loci disclosed in Chylinski, Rhun, and Charpentier, "The tracrRNA and Cas9 families of type II CRISPR-Cas immunity systems" (2013) RNA Biology 10:5, 726-737; the entire contents of which are incorporated herein by reference.

Deaminase

As used herein, the term "deaminase" or "deaminase domain" or "deaminase moiety" refers to a protein or enzyme that catalyzes a deamination reaction. In some embodiments, the deaminase is an adenosine deaminase, which catalyzes the hydrolytic deamination of adenine or adenosine (e.g., an engineered adenosine deaminase that deaminates adenosine in DNA). In some embodiments, the deaminase or deaminase domain is a cytidine deaminase, catalyzing the hydrolytic deamination of cytidine or deoxycytidine to uridine or deoxyuridine, respectively. In some embodiments, the deaminase or deaminase domain is a cytidine deaminase domain, catalyzing the hydrolytic deamination of cytosine to uracil. In some embodiments, the deaminase or deaminase domain is a naturally-occurring deaminase from an organism, such as a human, chimpanzee, gorilla, monkey, cow, dog, rat, or mouse. In some embodiments, the deaminase or deaminase domain is a variant of a naturally-occurring deaminase from an organism that does not occur in nature. For example, in some embodiments, the deaminase or deaminase domain is at least 50%, at least 55%, at least 60%, at least 65%, at least 70%, at least 75% at least 80%, at least 85%, at least 90%, at least 95%, at least 96%, at least 97%, at least 98%, at least 99%, or at least 99.5% identical to a naturally-occurring deaminase from an organism. The term deaminase also embraces any genetically engineered deaminase that may comprise genetic modifications (e.g., one or more mutations) that results in a variant deaminase having an amino acid sequence comprising one or more changes relative to a wildtype counterpart deaminase. Examples of deaminases are given herein, and the term is not meant to be limiting.

Effective Amount

The term "effective amount," as used herein, refers to an amount of a biologically active agent that is sufficient to elicit a desired biological response. For example, in some embodiments, an effective amount of a base editor may refer to the amount of the base editor that is sufficient to edit a target site nucleotide sequence, e.g., a genome. In some embodiments, an effective amount of a base editor provided herein, e.g., of a fusion protein comprising a nuclease-inactive Cas9 domain and a nucleic acid editing domain (e.g., a deaminase domain) may refer to the amount of the fusion protein that is sufficient to induce editing of a target site specifically bound and edited by the fusion protein. As will be appreciated by the skilled artisan, the effective amount of an agent, e.g., a fusion protein, a nuclease, a deaminase, a hybrid protein, a protein dimer, a complex of a protein (or protein dimer) and a polynucleotide, or a polynucleotide, may vary depending on various factors as, for example, on the desired biological response, e.g., on the specific allele, genome, or target site to be edited, on the cell or tissue being targeted, and on the agent being used.

Inhibitor of Base Repair

The term "inhibitor of base repair" or "IBR" refers to a protein that is capable of inhibiting the activity of a nucleic acid repair enzyme, for example a base excision repair enzyme. In some embodiments, the IBR is an inhibitor of inosine base excision repair. Exemplary inhibitors of base repair include inhibitors of APE1, Endo III, Endo IV, Endo V, Endo VIII, Fpg, hOGG1, hNEIL1, T7 EndoI, T4PDG, UDG, hSMUG1, and hAAG. In some embodiments, the IBR is an inhibitor of Endo V or hAAG. In some embodiments, the IBR is a catalytically inactive EndoV or a catalytically inactive hAAG.

Isolated

As used herein, the term "isolated protein" or "isolated nucleic acid" refers to a protein or nucleic acid that by virtue of its origin or source of derivation is not associated with naturally associated components that accompany it in its native state; is substantially free of other proteins or nucleic acids from the same species; is expressed by a cell from a different species; or does not occur in nature. Thus, a polypeptide or nucleic acid that is chemically synthesized or synthesized in a cellular system different from the cell from which it naturally originates will be "isolated" from its naturally associated components. A protein or nucleic acid may also be rendered substantially free of naturally associated components by isolation, using protein purification techniques well known in the art.

Linker

The term "linker," as used herein, refers to a chemical group or a molecule linking two molecules or moieties, e.g., a binding domain and a cleavage domain of a nuclease. In some embodiments, a linker joins a gRNA binding domain of an RNA-programmable nuclease and the catalytic domain of a recombinase. In some embodiments, a linker joins a dCas9 and base editor moiety (e.g., a cytidine or adenosine deaminase). Typically, the linker is positioned between, or flanked by, two groups, molecules, or other moieties and connected to each one via a covalent bond, thus connecting the two. In some embodiments, the linker is an amino acid or a plurality of amino acids (e.g., a peptide or protein). In some embodiments, the linker is an organic molecule, group, polymer, or chemical moiety. In some embodiments, the linker is 5-100 amino acids in length, for example, 5, 6, 7, 8, 9, 10, 11, 12, 13, 14, 15, 16, 17, 18, 19, 20, 21, 22, 23, 24, 25, 26, 27, 28, 29, 30, 30-35, 35-40, 40-45, 45-50, 50-60, 60-70, 70-80, 80-90, 90-100, 100-150, or 150-200 amino acids in length. Longer or shorter linkers are also contemplated.

Mutation

The term "mutation," as used herein, refers to a substitution of a residue within a sequence, e.g., a nucleic acid or amino acid sequence, with another residue, or a deletion or insertion of one or more residues within a sequence. Mutations are typically described herein by identifying the original residue followed by the position of the residue within the sequence and by the identity of the newly substituted residue. Various methods for making the amino acid substitutions (mutations) provided herein are well known in the art, and are provided by, for example, Green and Sambrook, *Molecular Cloning: A Laboratory Manual* ($4^{th}$ ed., Cold Spring Harbor Laboratory Press, Cold Spring Harbor, N.Y. (2012)). Mutations can include a variety of categories, such as single base polymorphisms, microduplication regions, indel, and inversions, and is not meant to be limiting in any way. Mutations can include "loss-of-function" mutations which is the normal result of a mutation that reduces or abolishes a protein activity. Most loss-of-function mutations are recessive, because in a heterozygote the second chromosome copy carries an unmutated version of the gene coding for a fully functional protein whose presence compensates for the effect of the mutation. There are some exceptions where a loss-of-function mutation is dominant, one example being haploinsufficiency, where the organism is unable to tolerate the approximately 50% reduction in protein activity suffered by the heterozygote. This is the explanation for a few genetic diseases in humans, including Marfan syndrome which results from a mutation in the gene for the connective tissue protein called fibrillin. Mutations also embrace "gain-of-function" mutations, which is one which confers an abnormal activity on a protein or cell that is otherwise not present in a normal condition. Many gain-of-function mutations are in regulatory sequences rather than in coding regions, and can therefore have a number of consequences. For example, a mutation might lead to one or more genes being expressed in the wrong tissues, these tissues gaining functions that they normally lack. Alternatively the mutation could lead to overexpression of one or more genes involved in control of the cell cycle, thus leading to uncontrolled cell division and hence to cancer. Because of their nature, gain-of-function mutations are usually dominant.

Non-Naturally Occurring or Engineered

The terms "non-naturally occurring" or "engineered" are used interchangeably and indicate the involvement of the hand of man. The terms, when referring to nucleic acid molecules or polypeptides (e.g., Cas9 or deaminases) mean that the nucleic acid molecule or the polypeptide is at least substantially free from at least one other component with which they are naturally associated in nature and/or as found in nature (e.g., an amino acid sequence not found in nature).

Nucleic Acid/Nucleic Acid Molecule

The terms "nucleic acid" and "nucleic acid molecule," as used herein, refer to a compound comprising a nucleobase and an acidic moiety, e.g., a nucleoside, a nucleotide, or a polymer of nucleotides. Typically, polymeric nucleic acids, e.g., nucleic acid molecules comprising three or more nucleotides are linear molecules, in which adjacent nucleotides are linked to each other via a phosphodiester linkage. In some embodiments, "nucleic acid" refers to individual nucleic acid residues (e.g. nucleotides and/or nucleosides). In some embodiments, "nucleic acid" refers to an oligonucleotide chain comprising three or more individual nucleotide residues.

Nucleic Acid Programmable R/DNA Binding Protein (napR/DNAbp)

The term "nucleic acid programmable D/RNA binding protein (napR/DNAbp)" refers to any protein that may associate (e.g., form a complex) with one or more nucleic acid molecules (i.e., which may broadly be referred to as a "napR/DNAbp-programming nucleic acid molecule" and includes, for example, guide RNA in the case of Cas systems) which direct or otherwise program the protein to localize to a specific target nucleotide sequence (e.g., a gene locus of a genome) that is complementary to the one or more nucleic acid molecules (or a portion or region thereof) associated with the protein, thereby causing the protein to bind to the nucleotide sequence at the specific target site. This term napR/DNAbp embraces CRISPR Cas 9 proteins, as well as Cas9 equivalents, homologs, orthologs, or paralogs, whether naturally occurring or non-naturally occurring (e.g., engineered or recombinant), and may include a Cas9 equivalent from any type of CRISPR system (e.g., type II, V, VI), including Cpf1 (a type-V CRISPR-Cas systems), C2c1 (a type V CRISPR-Cas system), C2c2 (a type VI CRISPR-Cas system) and C2c3 (a type V CRISPR-Cas system). Further Cas-equivalents are described in Makarova et al., "C2c2 is a single-component programmable RNA-guided RNA-targeting CRISPR effector," Science 2016; 353(6299), the contents of which are incorporated herein by reference. However, the nucleic acid programmable DNA binding protein (napDNAbp) that may be used in connection with this invention are not limited to CRISPR-Cas systems. The invention embraces any such programmable protein, such as the Argonaute protein from *Natronobacterium gregoryi* (NgAgo) which may also be used for DNA-guided genome editing. NgAgo-guide DNA system does not require a PAM sequence or guide RNA molecules, which means genome editing can be performed simply by the expression of generic NgAgo protein and introduction of synthetic oligonucleotides on any genomic sequence. See Gao F, Shen X Z, Jiang F, Wu Y, Han C. DNA-guided genome editing using the *Natronobacterium gregoryi* Argonaute. Nat Biotechnol 2016; 34(7):768-73, which is incorporated herein by reference.

napR/DNAbp-Programming Nucleic Acid Molecule or Guide Sequence

The term "napR/DNAbp-programming nucleic acid molecule" or equivalently "guide sequence" refers the one or more nucleic acid molecules which associate with and direct or otherwise program a napR/DNAbp protein to localize to a specific target nucleotide sequence (e.g., a gene locus of a genome) that is complementary to the one or more nucleic acid molecules (or a portion or region thereof) associated with the protein, thereby causing the napR/DNAbp protein to bind to the nucleotide sequence at the specific target site. A non-limiting example is a guide RNA of a Cas protein of a CRISPR-Cas genome editing system.

Nuclear Localization Signal (NLS)

A nuclear localization signal or sequence (NLS) is an amino acid sequence that tags, designates, or otherwise marks a protein for import into the cell nucleus by nuclear transport. Typically, this signal consists of one or more short sequences of positively charged lysines or arginines exposed on the protein surface. Different nuclear localized proteins may share the same NLS. An NLS has the opposite function of a nuclear export signal (NES), which targets proteins out of the nucleus. Thus, a single nuclear localization signal can direct the entity with which it is associated to the nucleus of a cell. Such sequences can be of any size and composition, for example more than 25, 25, 15, 12, 10, 8, 7, 6, 5 or 4 amino acids, but will preferably comprise at least a four to eight amino acid sequence known to function as a nuclear localization signal (NLS).

Nucleobase Modification Moiety or Nucleic Acid Effector Domain

The term, as used herein, "nucleobase modification moiety" or equivalently a "nucleic acid effector domain" embraces any protein, enzyme, or polypeptide (or functional fragment thereof) which is capable of modifying a DNA or RNA molecule. Nucleobase modification moieties can be naturally occurring, or can be recombinant. For example, a nucleobase modification moiety can include one or more DNA repair enzymes, for example, and an enzyme or protein involved in base excision repair (BER), nucleotide excision repair (NER), homology-dependent recombinational repair (HR), non-homologous end-joining repair (NHEJ), microhomology end-joining repair (MMEJ), mismatch repair (MMR), direct reversal repair, or other known DNA repair pathway. A nucleobase modification moiety can have one or more types of enzymatic activities, including, but not limited to endonuclease activity, polymerase activity, ligase activity, replication activity, proofreading activity. Nucleobase modification moieties can also include DNA or RNA-modifying enzymes and/or mutagenic enzymes, such as, DNA methylases and deaminating enzymes (i.e., deaminases, including cytidine deaminases and adenosine deaminases, all defined above), which deaminate nucleobases leading in some cases to mutagenic corrections by way of normal cellular DNA repair and replication processes. The "nucleic acid effector domain" (e.g., a DNA effector domain or an RNA effector domain) as used herein may also refer to a protein or enzyme capable of making one or more modifications (e.g., deamination of a cytidine residue) to a nucleic acid (e.g., DNA or RNA). Exemplary nucleic acid editing domains include, but are not limited to a deaminase, a nuclease, a nickase, a recombinase, a methyltransferase, a methylase, an acetylase, an acetyltransferase, a transcriptional activator, or a transcriptional repressor domain. In some embodiments the nucleic acid editing domain is a deaminase (e.g., a cytidine deaminase, such as an APOBEC or an AID deaminase).

Oligonucleotide/Polynucleotide

As used herein, the terms "oligonucleotide" and "polynucleotide" can be used interchangeably to refer to a polymer of nucleotides (e.g., a string of at least three nucleotides). In some embodiments, "nucleic acid" encompasses RNA as well as single and/or double-stranded DNA. Nucleic acids may be naturally occurring, for example, in the context of a genome, a transcript, an mRNA, tRNA, rRNA, siRNA, snRNA, a plasmid, cosmid, chromosome, chromatid, or other naturally occurring nucleic acid molecule. On the other hand, a nucleic acid molecule may be a non-naturally occurring molecule, e.g., a recombinant DNA or RNA, an artificial chromosome, an engineered genome, or fragment thereof, or a synthetic DNA, RNA, DNA/RNA hybrid, or including non-naturally occurring nucleotides or nucleosides. Furthermore, the terms "nucleic acid," "DNA," "RNA," and/or similar terms include nucleic acid analogs, e.g., analogs having other than a phosphodiester backbone. Nucleic acids can be purified from natural sources, produced using recombinant expression systems and optionally purified, chemically synthesized, etc. Where appropriate, e.g., in the case of chemically synthesized molecules, nucleic acids can comprise nucleoside analogs such as analogs having chemically modified bases or sugars, and backbone modifications. A nucleic acid sequence is presented in the 5' to 3' direction unless otherwise indicated. In some embodiments, a nucleic acid is or comprises natural nucleosides (e.g.

adenosine, thymidine, guanosine, cytidine, uridine, deoxyadenosine, deoxythymidine, deoxyguanosine, and deoxycytidine); nucleoside analogs (e.g., 2-aminoadenosine, 2-thiothymidine, inosine, pyrrolo-pyrimidine, 3-methyl adenosine, 5-methylcytidine, 2-aminoadenosine, C5-bromouridine, C5-fluorouridine, C5-iodouridine, C5-propynyl-uridine, C5-propynyl-cytidine, C5-methylcytidine, 2-aminoadenosine, 7-deazaadenosine, 7-deazaguanosine, 8-oxoadenosine, 8-oxoguanosine, O(6)-methylguanine, and 2-thiocytidine); chemically modified bases; biologically modified bases (e.g., methylated bases); intercalated bases; modified sugars (e.g., 2'-fluororibose, ribose, 2'-deoxyribose, arabinose, and hexose); and/or modified phosphate groups (e.g., phosphorothioates and 5'-N-phosphoramidite linkages).

Protein/Peptide/Polypeptide

The terms "protein," "peptide," and "polypeptide" are used interchangeably herein, and refer to a polymer of amino acid residues linked together by peptide (amide) bonds. The terms refer to a protein, peptide, or polypeptide of any size, structure, or function. Typically, a protein, peptide, or polypeptide will be at least three amino acids long. A protein, peptide, or polypeptide may refer to an individual protein or a collection of proteins. One or more of the amino acids in a protein, peptide, or polypeptide may be modified, for example, by the addition of a chemical entity such as a carbohydrate group, a hydroxyl group, a phosphate group, a farnesyl group, an isofarnesyl group, a fatty acid group, a linker for conjugation, functionalization, or other modification, etc. A protein, peptide, or polypeptide may also be a single molecule or may be a multi-molecular complex. A protein, peptide, or polypeptide may be just a fragment of a naturally occurring protein or peptide. A protein, peptide, or polypeptide may be naturally occurring, recombinant, or synthetic, or any combination thereof. The term "fusion protein" as used herein refers to a hybrid polypeptide which comprises protein domains from at least two different proteins. One protein may be located at the amino-terminal (N-terminal) portion of the fusion protein or at the carboxy-terminal (C-terminal) protein thus forming an "amino-terminal fusion protein" or a "carboxy-terminal fusion protein," respectively. A protein may comprise different domains, for example, a nucleic acid binding domain (e.g., the gRNA binding domain of Cas9 that directs the binding of the protein to a target site) and a nucleic acid cleavage domain or a catalytic domain of a recombinase. In some embodiments, a protein comprises a proteinaceous part, e.g., an amino acid sequence constituting a nucleic acid binding domain, and an organic compound, e.g., a compound that can act as a nucleic acid cleavage agent. In some embodiments, a protein is in a complex with, or is in association with, a nucleic acid, e.g., RNA. Any of the proteins provided herein may be produced by any method known in the art. For example, the proteins provided herein may be produced via recombinant protein expression and purification, which is especially suited for fusion proteins comprising a peptide linker. Methods for recombinant protein expression and purification are well known, and include those described by Green and Sambrook, Molecular Cloning: A Laboratory Manual (4th ed., Cold Spring Harbor Laboratory Press, Cold Spring Harbor, N.Y. (2012)), the entire contents of which are incorporated herein by reference. It should be appreciated that any of the disclosure provides any of the polypeptide sequences provided herein without an N-terminal methionine (M) residue.

Recombinant

The term "recombinant" as used herein in the context of proteins or nucleic acids refers to proteins or nucleic acids that do not occur in nature, but are the product of human engineering. For example, in some embodiments, a recombinant protein or nucleic acid molecule comprises an amino acid or nucleotide sequence that comprises at least one, at least two, at least three, at least four, at least five, at least six, or at least seven mutations as compared to any naturally occurring sequence.

RNA-Programmable Nuclease/RNA-Guided Nuclease

Figure 1E:
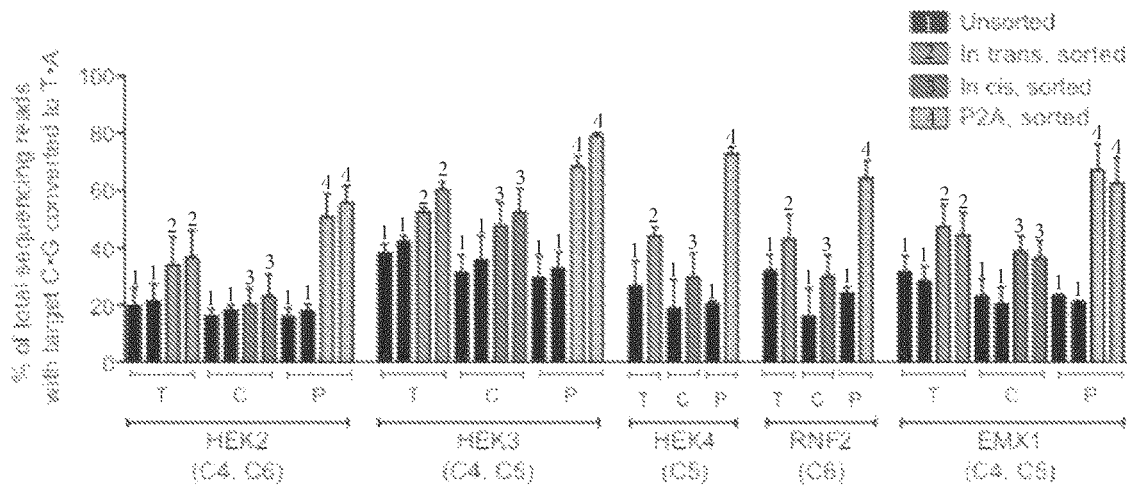

The term "RNA-programmable nuclease," and "RNA-guided nuclease" are used interchangeably herein and refer to a nuclease that forms a complex with (e.g., binds or associates with) one or more RNA that is not a target for cleavage (e.g., a Cas9 or homolog or variant thereof). In some embodiments, an RNA-programmable nuclease, when in a complex with an RNA, may be referred to as a nuclease:RNA complex. Typically, the bound RNA(s) is referred to as a guide RNA (gRNA). gRNAs can exist as a complex of two or more RNAs, or as a single RNA molecule. gRNAs that exist as a single RNA molecule may be referred to as single-guide RNAs (sgRNAs), though "gRNA" is used interchangeably to refer to guide RNAs that exist as either single molecules or as a complex of two or more molecules. Typically, gRNAs that exist as single RNA species comprise two domains: (1) a domain that shares homology to a target nucleic acid (e.g., and directs binding of a Cas9 (or equivalent) complex to the target); and (2) a domain that binds a Cas9 protein. In some embodiments, domain (2) corresponds to a sequence known as a tracrRNA, and comprises a stem-loop structure. For example, in some embodiments, domain (2) is homologous to a tracrRNA as depicted in FIG. 1E of Jinek et al., Science 337:816-821 (2012), the entire contents of which is incorporated herein by reference. Other examples of gRNAs (e.g., those including domain 2) can be found in U.S. Provisional Patent Application, U.S. Ser. No. 61/874,682, filed Sep. 6, 2013, entitled "Switchable Cas9 Nucleases And Uses Thereof," and U.S. Provisional Patent Application, U.S. Ser. No. 61/874,746, filed Sep. 6, 2013, entitled "Delivery System For Functional Nucleases," the entire contents of each are hereby incorporated by reference in their entirety. In some embodiments, a gRNA comprises two or more of domains (1) and (2), and may be referred to as an "extended gRNA." For example, an extended gRNA will, e.g., bind two or more Cas9 proteins and bind a target nucleic acid at two or more distinct regions, as described herein. The gRNA comprises a nucleotide sequence that complements a target site, which mediates binding of the nuclease/RNA complex to said target site, providing the sequence specificity of the nuclease:RNA complex. In some embodiments, the RNA-programmable nuclease is the (CRISPR-associated system) Cas9 endonuclease, for example Cas9 (Csn1) from *Streptococcus pyogenes* (see, e.g., "Complete genome sequence of an M1 strain of *Streptococcus pyogenes*." Ferretti J. J., McShan W. M., Ajdic D. J., Savic D. J., Savic G., Lyon K., Primeaux C., Sezate S., Suvorov A. N., Kenton S., Lai H. S., Lin S. P., Qian Y., Jia H. G., Najar F. Z., Ren Q., Zhu H., Song L., White J., Yuan X., Clifton S. W., Roe B. A., McLaughlin R. E., Proc. Natl. Acad. Sci. U.S.A. 98:4658-4663(2001); "CRISPR RNA maturation by trans-encoded small RNA and host factor RNase III." Deltcheva E., Chylinski K., Sharma C. M., Gonzales K., Chao Y., Pirzada Z. A., Eckert M. R., Vogel J., Charpentier E., Nature 471:602-607(2011); and "A programmable dual-RNA-guided DNA endonuclease in adaptive bacterial immunity." Jinek M., Chylinski K., Fonfara I., Hauer M., Doudna J. A., Charpentier E. Science 337:816-821(2012), the entire contents of each of which are incorporated herein by reference.

Because RNA-programmable nucleases (e.g., Cas9) use RNA:DNA hybridization to target DNA cleavage sites, these proteins are able to be targeted, in principle, to any sequence specified by the guide RNA. Methods of using RNA-programmable nucleases, such as Cas9, for site-specific cleavage (e.g., to modify a genome) are known in the art (see e.g., Cong, L. et al. Multiplex genome engineering using CRISPR/Cas systems. *Science* 339, 819-823 (2013); Mali, P. et al. RNA-guided human genome engineering via Cas9. *Science* 339, 823-826 (2013); Hwang, W. Y. et al. Efficient genome editing in zebrafish using a CRISPR-Cas system. *Nature biotechnology* 31, 227-229 (2013); Jinek, M. et al. RNA-programmed genome editing in human cells. *eLife* 2, e00471 (2013); Dicarlo, J. E. et al. Genome engineering in *Saccharomyces cerevisiae* using CRISPR-Cas systems. *Nucleic acids research* (2013); Jiang, W. et al. RNA-guided editing of bacterial genomes using CRISPR-Cas systems. *Nature biotechnology* 31, 233-239 (2013); the entire contents of each of which are incorporated herein by reference).

Subject

The term "subject," as used herein, refers to an individual organism, for example, an individual mammal. In some embodiments, the subject is a human. In some embodiments, the subject is a non-human mammal. In some embodiments, the subject is a non-human primate. In some embodiments, the subject is a rodent. In some embodiments, the subject is a sheep, a goat, a cattle, a cat, or a dog. In some embodiments, the subject is a vertebrate, an amphibian, a reptile, a fish, an insect, a fly, or a nematode. In some embodiments, the subject is a research animal. In some embodiments, the subject is genetically engineered, e.g., a genetically engineered non-human subject. The subject may be of either sex and at any stage of development.

Target Site

The term "target site" refers to a sequence within a nucleic acid molecule that is deaminated by a deaminase or a fusion protein comprising a deaminase (e.g., a dCas9-deaminase fusion protein provided herein).

Uracil Glycosylase Inhibitor or UGI

The term "uracil glycosylase inhibitor" or "UGI," as used herein, refers to a protein that is capable of inhibiting a uracil-DNA glycosylase base-excision repair enzyme. In some embodiments, a UGI domain comprises a wild-type UGI or a UGI as set forth in SEQ ID NO: 10 or 108. In some embodiments, the UGI proteins provided herein include fragments of UGI and proteins homologous to a UGI or a UGI fragment. For example, in some embodiments, a UGI domain comprises a fragment of the amino acid sequence set forth in SEQ ID NO: 10 or 108. In some embodiments, a UGI fragment comprises an amino acid sequence that comprises at least 60%, at least 65%, at least 70%, at least 75%, at least 80%, at least 85%, at least 90%, at least 95%, at least 96%, at least 97%, at least 98%, at least 99%, or at least 99.5% of the amino acid sequence as set forth in SEQ ID NO: 10 or 108. In some embodiments, a UGI comprises an amino acid sequence homologous to the amino acid sequence set forth in SEQ ID NO: 10 or 108, or an amino acid sequence homologous to a fragment of the amino acid sequence set forth in SEQ ID NO: 10 or 108. In some embodiments, proteins comprising UGI or fragments of UGI or homologs of UGI or UGI fragments are referred to as "UGI variants." A UGI variant shares homology to UGI, or a fragment thereof. For example a UGI variant is at least 70% identical, at least 75% identical, at least 80% identical, at least 85% identical, at least 90% identical, at least 95% identical, at least 96% identical, at least 97% identical, at least 98% identical, at least 99% identical, at least 99.5% identical, or at least 99.9% identical to a wild type UGI or a UGI as set forth in SEQ ID NO: 10 or 108. In some embodiments, the UGI variant comprises a fragment of UGI, such that the fragment is at least 70% identical, at least 80% identical, at least 90% identical, at least 95% identical, at least 96% identical, at least 97% identical, at least 98% identical, at least 99% identical, at least 99.5% identical, or at least 99.9% to the corresponding fragment of wild-type UGI or a UGI as set forth in SEQ ID NO: 10 or 108. In some embodiments, the UGI comprises the following amino acid sequence:

```
                                      (SEQ ID NO: 10)
MTNLSDIIEKETGKQLVIQESILMLPEEVEEVIGNKPESDILVHTAYDE

STDENVMLLTSDAPEYKPWALVIQDSNGENKIKML (P14739|UNGI_BPPB2 Uracil-DNA glycosylase
inhibitor).
```

Treatment

The terms "treatment," "treat," and "treating," refer to a clinical intervention aimed to reverse, alleviate, delay the onset of, or inhibit the progress of a disease or disorder, or one or more symptoms thereof, as described herein. As used herein, the terms "treatment," "treat," and "treating" refer to a clinical intervention aimed to reverse, alleviate, delay the onset of, or inhibit the progress of a disease or disorder, or one or more symptoms thereof, as described herein. In some embodiments, treatment may be administered after one or more symptoms have developed and/or after a disease has been diagnosed. In other embodiments, treatment may be administered in the absence of symptoms, e.g., to prevent or delay onset of a symptom or inhibit onset or progression of a disease. For example, treatment may be administered to a susceptible individual prior to the onset of symptoms (e.g., in light of a history of symptoms and/or in light of genetic or other susceptibility factors). Treatment may also be continued after symptoms have resolved, for example, to prevent or delay their recurrence.

Variant

As used herein the term "variant" should be taken to mean the exhibition of qualities that have a pattern that deviates from what occurs in nature, e.g., a variant Cas9 is a Cas9 comprising one or more changes in amino acid residues as compared to a wild type Cas9 amino acid sequence.

Wild Type

As used herein the term "wild type" is a term of the art understood by skilled persons and means the typical form of an organism, strain, gene or characteristic as it occurs in nature as distinguished from mutant or variant forms.

Detailed Description of Certain Embodiments

The specification relates to improved base editors that achieve a significant increase in editing efficiencies by making various modifications which address certain underlying biological restrictions (e.g., restricted expression and nuclear localization) in known base editor systems surprisingly found to significantly reduce the efficiency of genome editing that is achievable by base editing. In particular, the inventors surprisingly found that base editor modifications (e.g., base editors comprising improved codon-usage and at least two NLSs) resulting in improved expression and nuclear localization and thereby improved editing efficiencies.

Despite these recent advances in the design of base editors, the efficiency of base editing varies widely. To increase base editing efficiency, the inventors sought to identify the factors that limit base editing efficiency in cells. It was surprisingly found by the inventors that expression and nuclear localization in human cells imposed key bottlenecks on editing efficiency. The inventors discovered that optimizing codon usage, using improved nuclear localization sequences (NLSs) (e.g., at least two NLS moieties), and performing ancestral reconstruction of deaminases resulted in base editors with greatly increased editing efficiency, often more than doubling target nucleotide conversion yields as compared to the unmodified counterpart editors. The resulting base editors were shown, as demonstrated in the Examples, to install point mutations relevant to human disease in a variety of mammalian cell types much more efficiently than previously described base editors. These approaches can be used to provide improved base editors that can be used to efficiently edit a nucleic acid molecule in a manner that is dramatically improved as compared to base editors known in the art. The improved base editors may be used to efficiently edit nucleic acid molecules, e.g., a genome, for example, by correcting a disease-causing point mutation.

Thus, the instant specification provides improved base editors that comprise one or modifications that result in increased expression (e.g., by way of optimizing codon usage and/or conducting ancestral reconstruction of deaminases) and/or nuclear localization. Further, the specification in certain aspects describes nucleic acid molecules encoding and/or expressing the improved base editors disclosed herein, as well as cloning and/or expression vectors for cloning and/or expressing the improved base editors described herein, host cells comprising said nucleic acid molecules and cloning and/or expression vectors, and compositions for delivering and/or administering nucleic acid-based embodiments described herein. In addition, the disclosure provides for improved base editors, as well as compositions comprising said improved base editors. Still further, the present disclosure provides for methods of making the improved base editors, as well as methods of using the improved base editors or nucleic acid molecules encoding the improved base editors in applications including editing a nucleic acid molecule, e.g., a genome, with improved efficiency as compared to base editor that forms the state of the art. The specification also provides methods for efficiently editing a target nucleic acid molecule, e.g., a single nucleobase of a genome, with a base editing system described herein (e.g., in the form of an improved base editor protein or a vector encoding same) and conducting based editing. Still further, the specification provides therapeutic methods for treating a genetic disease and/or for altering or changing a genetic trait or condition by contacting a target nucleic acid molecule, e.g., a genome, with a base editing system (e.g., in the form of an improved base editor protein or a vector encoding same) and conducting based editing to treat the genetic disease and/or change the genetic trait (e.g., eye color).

I. Improved Base-Editors

In various aspects, the instant specification provides improved base editors that comprising one or modifications that result in increased expression (e.g., by way of optimizing codon usage and/or conducting ancestral reconstruction of deaminases) and/or nuclear localization (e.g., by incorporating at least two NLSs). The improved base editors described herein achieve a significant increase in editing efficiencies as compared to unmodified counterparts by making various modifications which address certain fundamental underlying biological restrictions in known base editor systems surprisingly found to significantly reduce the efficiency of genome editing that is achievable by base editing. In particular, the inventors surprising found that base editor modifications resulting in improved expression and nuclear localization specifically resulted in improved editing efficiencies.

In certain aspects, the methods described herein for modifying and improving base editors begins with a base editor known in the art upon which one or improvements are imparted. The state of the art has described numerous base editors as of this filing. The methods and approaches herein described for improving base editors may be applied to any previously known base editor, or to base editors that may be developed in the further but which lack the beneficial characteristics imparted by the instant methods and modification approaches. Exemplary base editors that may be modified by the methods described herein to achieve the improved base editors of the invention can include, for example, those described in the following references and/or patent publications, each of which are incorporated by reference in their entireties: (a) PCT/US2014/070038 (published as WO2015/089406, Jun. 18, 2015) and its equivalents in the US or around the world; (b) PCT/US2016/058344 (published as WO2017/070632, Apr. 27, 2017) and its equivalents in the US or around the world; (c) PCT/US2016/058345 (published as WO2017/070633, Apr. 27, 2017) and its equivalent in the US or around the world; (d) PCT/US2017/045381 (published as WO2018/027078, Feb. 8, 2018) and its equivalents in the US or around the world; (e) PCT/US2017/056671 (published as WO2018/071868, Apr. 19, 2018) and its equivalents in the US or around the world; PCT/2017/048390 (WO2017/048390, Mar. 23, 2017) and its equivalents in the US or around the world; (f) PCT/US2017/068114 (not published) and its equivalents in the US or around the world; (g) PCT/US2017/068105 (not published) and its equivalents in the US or around the world; (h) PCT/US2017/046144 (WO2018/031683, Feb. 15, 2018) and its equivalents in the US or around the world; (i) PCT/US2018/024208 (not published) and its equivalents in the US or around the world; (j) PCT/2018/021878 (WO2018/021878, Feb. 1, 2018) and its equivalents in the US and around the world; (k) Komor, A. C., Kim, Y. B., Packer, M. S., Zuris, J. A. & Liu, D. R. Programmable editing of a target base in genomic DNA without double-stranded DNA cleavage. Nature 533, 420-(2016); (1) Gaudelli, N. M. et al. Programmable base editing of A. T to G. C in genomic DNA without DNA cleavage. Nature 551, 464-(2017); (m) any of the references listed in this specification entitled "References" and which reports or describes a base editor known in the art.

In various aspects, the improved or modified base editors described herein have the following generalized structure:

A-B—C, wherein "A" is a Cas moiety or napDNAbp, "B" is nucleic acid effector domain (e.g., a deaminase, such as a cytidine or adenosine deaminase), and "C" is as least two nuclear localization signals (NLS). In addition, the "-" represents a linker that covalently joins moieties A, B, and C. The linkers can be any suitable type (e.g., amino acid sequences or other biopolymers, or synthetic chemical linkages in the case where the moieties are bioconjugated to one another) or length. In addition, a functional improved base editor of the invention would also include one or more "R" or guide sequences (e.g., guide RNA in the case of a Cas9 or Cas9 equivalent) in order to carry out the R/DNA-programmable functionality of base editors for targeting specific sites to be corrected.

The order of linkage of the moieties is not meant to be particularly limiting so long as the particular arrangement of the elements of moieties produces a functional base editor. That is, the improved base editors of the invention may also include editors represented by the following structures:

B-A-C;

B—C-A;

C—B-A;

C-A-B; and

A-C—B.

In some embodiments, the improved base editors provided herein can be made a recombinant fusion protein comprising one or more protein domains, thereby generating an improved base editor. In certain embodiments, the base editors provided herein comprise one or more features that improve the base editing activity (e.g., efficiency, selectivity, and/or specificity) of the base editor proteins. For example, the base editor proteins provided herein may comprise a Cas9 domain that has reduced nuclease activity. In some embodiments, the base editor proteins provided herein may have a Cas9 domain that does not have nuclease activity (dCas9), or a Cas9 domain that cuts one strand of a duplexed DNA molecule, referred to as a Cas9 nickase (nCas9). Without wishing to be bound by any particular theory, the presence of the catalytic residue (e.g., H840) maintains the activity of the Cas9 to cleave the non-edited (e.g., non-deaminated) strand containing a T opposite the targeted A. Mutation of the catalytic residue (e.g., D10 to A10) of Cas9 prevents cleavage of the edited strand containing the targeted A residue. Such Cas9 variants are able to generate a single-strand DNA break (nick) at a specific location based on the gRNA-defined target sequence, leading to repair of the non-edited strand, ultimately resulting in a T to C change on the non-edited strand.

In some embodiments, any of the base editor proteins provided herein may further comprise one or more additional nucleic acid effector moieties, such as, for example, an inhibitor of inosine base excision repair (e.g., a uracil glycosylase inhibitor (UGI) domain or a catalytically inactive inosine-specific nuclease (dISN)). Without wishing to be bound by any particular theory, the UGI domain or dISN may inhibit or prevent base excision repair of a deaminated adenosine residue (e.g., inosine), which may improve the activity or efficiency of the base editor.

The Cas9 Moiety or Equivalent Protein

The improved base editors provided by the instant specification include any suitable Cas9 moiety or equivalent protein, such as a CRISPR associated protein 9, or functional fragment thereof, and embraces any naturally occurring Cas9 from any organism, any naturally-occurring Cas9 equivalent or functional fragment thereof, any Cas9 homolog, ortholog, or paralog from any organism, and any mutant or variant of a Cas9, naturally-occurring or engineered. More broadly, a Cas9 is a type of "RNA-programmable nuclease" or "RNA-guided nuclease" or "nucleic acid programmable DNA-binding protein." The terms napR/DNAbp or Cas9 are not meant to be particularly limiting.

The present disclosure is unlimited with regard to the particular napR/DNAbp, Cas9 or Cas9 equivalent that is employed in the improved base editors of the invention.

In some embodiments, the napR/DNAbp is a Cas moiety.

In various embodiment, the Cas moiety is a *S. pyogenes* Cas9, which has been mostly widely used as a tool for genome engineering. This Cas9 protein is a large, multi-domain protein containing two distinct nuclease domains. Point mutations can be introduced into Cas9 to abolish nuclease activity, resulting in a dead Cas9 (dCas9) that still retains its ability to bind DNA in a sgRNA-programmed manner. In principle, when fused to another protein or domain, dCas9 can target that protein to virtually any DNA sequence simply by co-expression with an appropriate sgRNA.

In other embodiments, the Cas moiety is a Cas9 from: *Corynebacterium ulcerans* (NCBI Refs: NC_015683.1, NC_017317.1); *Corynebacterium diphtheria* (NCBI Refs: NC_016782.1, NC_016786.1); *Spiroplasma syrphidicola* (NCBI Ref: NC_021284.1); *Prevotella intermedia* (NCBI Ref: NC_017861.1); *Spiroplasma taiwanense* (NCBI Ref: NC_021846.1); *Streptococcus iniae* (NCBI Ref: NC_021314.1); *Belliella baltica* (NCBI Ref: NC_018010.1); *Psychroflexus torquis* I (NCBI Ref: NC_018721.1); *Streptococcus thermophilus* (NCBI Ref: YP_820832.1); *Listeria innocua* (NCBI Ref: NP_472073.1); *Campylobacter jejuni* (NCBI Ref: YP_002344900.1); or *Neisseria. meningitidis* (NCBI Ref: YP_002342100.1).

In still other embodiments, the Cas moiety may include any CRISPR associated protein, including but not limited to, Cas1, Cas1B, Cas2, Cas3, Cas4, Cas5, Cas6, Cas7, Cas8, Cas9 (also known as Csn1 and Csx12), Cas10, Csy1, Csy2, Csy3, Cse1, Cse2, Csc1, Csc2, Csa5, Csn2. Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, Csf4, homologs thereof, or modified versions thereof. These enzymes are known; for example, the amino acid sequence of *S. pyogenes* Cas9 protein may be found in the SwissProt database under accession number Q99ZW2. In some embodiments, the unmodified CRISPR enzyme has DNA cleavage activity, such as Cas9. In some embodiments the CRISPR enzyme is Cas9, and may be Cas9 from *S. pyogenes* or *S. pneumoniae*. In some embodiments, the CRISPR enzyme directs cleavage of one or both strands at the location of a target sequence, such as within the target sequence and/or within the complement of the target sequence. In some embodiments, the CRISPR enzyme directs cleavage of one or both strands within about 1, 2, 3, 4, 5, 6, 7, 8, 9, 10, 15, 20, 25, 50, 100, 200, 500, or more base pairs from the first or last nucleotide of a target sequence. In some embodiments, a vector encodes a CRISPR enzyme that is mutated to with respect to a corresponding wild-type enzyme such that the mutated CRISPR enzyme lacks the ability to cleave one or both strands of a target polynucleotide containing a target sequence. For example, an aspartate-to-alanine substitution (D10A) in the RuvC I catalytic domain of Cas9 from *S. pyogenes* converts Cas9 from a nuclease that cleaves both strands to a nickase (cleaves a single strand). Other examples of mutations that render Cas9 a nickase include, without limitation, H840A, N854A, and N863A.

A Cas moiety may also be referred to as a casn1 nuclease or a CRISPR (clustered regularly interspaced short palindromic repeat)-associated nuclease. As outlined above, CRISPR is an adaptive immune system that provides protection against mobile genetic elements (viruses, transposable elements and conjugative plasmids). CRISPR clusters contain spacers, sequences complementary to antecedent mobile elements, and target invading nucleic acids. CRISPR clusters are transcribed and processed into CRISPR RNA (crRNA). In type II CRISPR systems correct processing of pre-crRNA requires a trans-encoded small RNA (tracrRNA), endogenous ribonuclease 3 (rnc) and a Cas9 protein. The tracrRNA serves as a guide for ribonuclease 3-aided processing of pre-crRNA. Subsequently, Cas9/crRNA/tracrRNA endonucleolytically cleaves linear or circular dsDNA target complementary to the spacer. The target strand not complementary to crRNA is first cut endonucleolytically, then trimmed 3'-5' exonucleolytically. In nature, DNA-binding and cleavage typically requires protein and both RNAs. However, single guide RNAs ("sgRNA", or simply "gNRA") can be engineered so as to incorporate aspects of both the crRNA and tracrRNA into a single RNA species. See, e.g., Jinek M., Chylinski K., Fonfara I., Hauer M., Doudna J. A., Charpentier E. *Science* 337:816-821 (2012), the entire contents of which is hereby incorporated by reference.

Cas9 and equivalents recognizes a short motif in the CRISPR repeat sequences (the PAM or protospacer adjacent motif) to help distinguish self versus non-self. As noted herein, Cas9 nuclease sequences and structures are well known to those of skill in the art (see, e.g., "Complete genome sequence of an M1 strain of *Streptococcus pyogenes*." Ferretti et al., J. J., McShan W. M., Ajdic D. J., Savic D. J., Savic G., Lyon K., Primeaux C., Sezate S., Suvorov A. N., Kenton S., Lai H. S., Lin S. P., Qian Y., Jia H. G., Najar F. Z., Ren Q., Zhu H., Song L., White J., Yuan X., Clifton S. W., Roe B. A., McLaughlin R. E., Proc. Natl. Acad. Sci. U.S.A. 98:4658-4663(2001); "CRISPR RNA maturation by trans-encoded small RNA and host factor RNase III." Deltcheva E., Chylinski K., Sharma C. M., Gonzales K., Chao Y., Pirzada Z. A., Eckert M. R., Vogel J., Charpentier E., Nature 471:602-607(2011); and "A programmable dual-RNA-guided DNA endonuclease in adaptive bacterial immunity." Jinek M., Chylinski K., Fonfara I., Hauer M., Doudna J. A., Charpentier E. *Science* 337:816-821(2012), the entire contents of each of which are incorporated herein by reference).

The Cas moiety may include any suitable homologs and/or orthologs. Cas9 homologs and/or orthologs have been described in various species, including, but not limited to, *S. pyogenes* and *S. thermophilus*. Additional suitable Cas9 nucleases and sequences will be apparent to those of skill in the art based on this disclosure, and such Cas9 nucleases and sequences include Cas9 sequences from the organisms and loci disclosed in Chylinski, Rhun, and Charpentier, "The tracrRNA and Cas9 families of type II CRISPR-Cas immunity systems" (2013) RNA Biology 10:5, 726-737; the entire contents of which are incorporated herein by reference. In some embodiments, a Cas9 nuclease has an inactive (e.g., an inactivated) DNA cleavage domain, that is, the Cas9 is a nickase.

In various embodiments, the improved base editors may comprise a nuclease-inactivated Cas protein may interchangeably be referred to as a "dCas" or "dCas9" protein (for nuclease-"dead" Cas9). Methods for generating a Cas9 protein (or a fragment thereof) having an inactive DNA cleavage domain are known (See, e.g., Jinek et al., *Science*. 337:816-821(2012); Qi et al., "Repurposing CRISPR as an RNA-Guided Platform for Sequence-Specific Control of Gene Expression" (2013) *Cell*. 28; 152(5):1173-83, the entire contents of each of which are incorporated herein by reference). For example, the DNA cleavage domain of Cas9 is known to include two subdomains, the HNH nuclease subdomain and the RuvC1 subdomain. The HNH subdomain cleaves the strand complementary to the gRNA, whereas the RuvC1 subdomain cleaves the non-complementary strand. Mutations within these subdomains can silence the nuclease activity of Cas9. For example, the mutations D10A and H840A completely inactivate the nuclease activity of *S. pyogenes* Cas9 (Jinek et al., *Science*. 337:816-821 (2012); Qi et al., Cell. 28; 152(5):1173-83 (2013)). In some embodiments, proteins comprising fragments of Cas9 are provided. For example, in some embodiments, a protein comprises one of two Cas9 domains: (1) the gRNA binding domain of Cas9; or (2) the DNA cleavage domain of Cas9.

In some embodiments, proteins comprising Cas9 or fragments thereof are referred to as "Cas9 variants." A Cas9 variant shares homology to Cas9, or a fragment thereof. For example a Cas9 variant is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% identical to wild type Cas9. In some embodiments, the Cas9 variant may have 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50 or more amino acid changes compared to a wild type Cas9. In some embodiments, the Cas9 variant comprises a fragment of Cas9 (e.g., a gRNA binding domain or a DNA-cleavage domain), such that the fragment is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% identical to the corresponding fragment of wild type Cas9. In some embodiments, the fragment is at least 30%, at least 35%, at least 40%, at least 45%, at least 50%, at least 55%, at least 60%, at least 65%, at least 70%, at least 75%, at least 80%, at least 85%, at least 90%, at least 95% identical, at least 96%, at least 97%, at least 98%, at least 99%, or at least 99.5% of the amino acid length of a corresponding wild type Cas9.

In some embodiments, the Cas9 fragment is at least 100 amino acids in length. In some embodiments, the fragment is at least 100, 150, 200, 250, 300, 350, 400, 450, 500, 550, 600, 650, 700, 750, 800, 850, 900, 950, 1000, 1050, 1100, 1150, 1200, 1250, or at least 1300 amino acids in length. In some embodiments, wild type Cas9 corresponds to Cas9 from *Streptococcus pyogenes* (NCBI Reference Sequence: NC_017053.1). In other embodiments, wild type Cas9 corresponds to Cas9 from *Streptococcus pyogenes* (NCBI Reference Sequence: NC_002737.2). In still other embodiments, dCas9 corresponds to, or comprises in part or in whole, a Cas9 amino acid sequence having one or more mutations that inactivate the Cas9 nuclease activity.

In some embodiments, the Cas9 domain comprises a D10A mutation, while the residue at position 840 relative to a wild type sequence such as Cas9 from *Streptococcus pyogenes* (NCBI Reference Sequence: NC_017053.1).

Without wishing to be bound by any particular theory, the presence of the catalytic residue H840 restores the activity of the Cas9 to cleave the non-edited (e.g., non-deaminated) strand containing a G opposite the targeted C. Restoration of H840 (e.g., from A840) does not result in the cleavage of the target strand containing the C. Such Cas9 variants are able to generate a single-strand DNA break (nick) at a specific location based on the gRNA-defined target sequence, leading to repair of the non-edited strand, ultimately resulting in a G to A change on the non-edited strand. Briefly, the C of a C-G basepair can be deaminated to a U by a deaminase, e.g., an APOBEC deaminase. Nicking the non-edited strand, having the G, facilitates removal of the G via mismatch repair mechanisms. UGI inhibits UDG, which prevents removal of the U.

In other embodiments, dCas9 variants having mutations other than D10A and H840A are provided, which, e.g., result in nuclease inactivated Cas9 (dCas9). Such mutations, by way of example, include other amino acid substitutions at D10 and H820, or other substitutions within the nuclease domains of Cas9 (e.g., substitutions in the HNH nuclease subdomain and/or the RuvC1 subdomain) with reference to a wild type sequence such as Cas9 from *Streptococcus pyogenes* (NCBI Reference Sequence: NC_017053.1). In some embodiments, variants or homologues of dCas9 (e.g., variants of Cas9 from *Streptococcus pyogenes* (NCBI Reference Sequence: NC_017053.1)) are provided which are at least about 70% identical, at least about 80% identical, at least about 90% identical, at least about 95% identical, at least about 98% identical, at least about 99% identical, at least about 99.5% identical, or at least about 99.9% identical to NCBI Reference Sequence: NC_017053.1. In some embodiments, variants of dCas9 (e.g., variants of NCBI Reference Sequence: NC_017053.1) are provided having amino acid sequences which are shorter, or longer than NC_017053.1 by about 5 amino acids, by about 10 amino acids, by about 15 amino acids, by about 20 amino acids, by about 25 amino acids, by about 30 amino acids, by about 40 amino acids, by about 50 amino acids, by about 75 amino acids, by about 100 amino acids or more.

In some embodiments, the base editors as provided herein comprise the full-length amino acid sequence of a Cas9 protein, e.g., one of the Cas9 sequences provided herein. In other embodiments, however, fusion proteins as provided herein do not comprise a full-length Cas9 sequence, but only a fragment thereof. For example, in some embodiments, a Cas9 fusion protein provided herein comprises a Cas9 fragment, wherein the fragment binds crRNA and tracrRNA or sgRNA, but does not comprise a functional nuclease domain, e.g., in that it comprises only a truncated version of a nuclease domain or no nuclease domain at all. Exemplary amino acid sequences of suitable Cas9 domains and Cas9 fragments are provided herein, and additional suitable sequences of Cas9 domains and fragments will be apparent to those of skill in the art.

It should be appreciated that additional Cas9 proteins (e.g., a nuclease dead Cas9 (dCas9), a Cas9 nickase (nCas9), or a nuclease active Cas9), including variants and homologs thereof, are within the scope of this disclosure. Exemplary Cas9 proteins include, without limitation, those provided below. In some embodiments, the Cas9 protein is a nuclease dead Cas9 (dCas9). In some embodiments, the dCas9 comprises the amino acid sequence (SEQ ID NO: 53). In some embodiments, the Cas9 protein is a Cas9 nickase (nCas9). In some embodiments, the nCas9 comprises the amino acid sequence (SEQ ID NO: 54). In some embodiments, the Cas9 protein is a nuclease active Cas9. In some embodiments, the nuclease active Cas9 comprises the amino acid sequence (SEQ ID NO: 55).

Exemplary Catalytically Inactive Cas9 (dCas9) (SEQ ID NO: 53):

(SEQ ID NO: 53)
DKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFH

RLEESFLVEEDKKHERHPIFGNIVDEVAYHEKYPTIYHLRKKLVDSTDK

ADLRLIYLALAHMIKFRGHFLIEGDLNPDNSDVDKLFIQLVQTYNQLFE

ENPINASGVDAKAILSARLSKSRRLENLIAQLPGEKKNGLFGNLIALSL

GLTPNFKSNFDLAEDAKLQLSKDTYDDDLDNLLAQIGDQYADLFLAAKN

LSDAILLSDILRVNTEITKAPLSASMIKRYDEHHQDLTLLKALVRQQLP

EKYKEIFFDQSKNGYAGYIDGGASQEEFYKFIKPILEKMDGTEELLVKL

NREDLLRKQRTFDNGSIPHQIHLGELHAILRRQEDFYPFLKDNREKIEK

ILTFRIPYYVGPLARGNSRFAWMTRKSEETITPWNFEEVVDKGASAQSF

IERMTNFDKNLPNEKVLPKHSLLYEYFTVYNELTKVKYVTEGMRKPAFL

SGEQKKAIVDLLFKTNRKVTVKQLKEDYFKKIECFDSVEISGVEDRFNA

SLGTYHDLLKIIKDKDFLDNEENEDILEDIVLTLTLFEDREMIEERLKT

YAHLFDDKVMKQLKRRRYTGWGRLSRKLINGIRDKQSGKTILDFLKSDG

FANRNFMQLIHDDSLTFKEDIQKAQVSGQGDSLHEHIANLAGSPAIKKG

ILQTVKVVDELVKVMGRHKPENIVIEMARENQTTQKGQKNSRERMKRIE

EGIKELGSQILKEHPVENTQLQNEKLYLYYLQNGRDMYVDQELDINRLS

DYDVDAIVPQSFLKDDSIDNKVLTRSDKNRGKSDNVPSEEVVKKMKNYW

RQLLNAKLITQRKFDNLTKAERGGLSELDKAGFIKRQLVETRQITKHVA

QILDSRMNTKYDENDKLIREVKVITLKSKLVSDFRKDFQFYKVREINNY

HHAHDAYLNAVVGTALIKKYPKLESEFVYGDYKVYDVRKMIAKSEQEIG

KATAKYFFYSNIMNFFKTEITLANGEIRKRPLIETNGETGEIVWDKGRD

FATVRKVLSMPQVNIVKKTEVQTGGFSKESILPKRNSDKLIARKKDWDP

KKYGGFDSPTVAYSVLVVAKVEKGKSKKLKSVKELLGITIMERSSFEKN

PIDFLEAKGYKEVKKDLIIKLPKYSLFELENGRKRMLASAGELQKGNEL

ALPSKYVNFLYLASHYEKLKGSPEDNEQKQLFVEQHKHYLDEIIEQISE

FSKRVILADANLDKVLSAYNKHRDKPIREQAENIIHLFTLTNLGAPAAF

KYFDTTIDRKRYTSTKEVLDATLIHQSITGLYETRIDLSQLGGD

Exemplary Cas9 Nickase (nCas9) (SEQ ID NO: 54):

(SEQ ID NO: 54)
DKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFH

RLEESFLVEEDKKHERHPIFGNIVDEVAYHEKYPTIYHLRKKLVDSTDK

ADLRLIYLALAHMIKFRGHFLIEGDLNPDNSDVDKLFIQLVQTYNQLFE

ENPINASGVDAKAILSARLSKSRRLENLIAQLPGEKKNGLFGNLIALSL

GLTPNFKSNFDLAEDAKLQLSKDTYDDDLDNLLAQIGDQYADLFLAAKN

LSDAILLSDILRVNTEITKAPLSASMIKRYDEHHQDLTLLKALVRQQLP

EKYKEIFFDQSKNGYAGYIDGGASQEEFYKFIKPILEKMDGTEELLVKL

-continued
NREDLLRKQRTFDNGSIPHQIHLGELHAILRRQEDFYPFLKDNREKIEK

ILTFRIPYYVGPLARGNSRFAWMTRKSEETITPWNFEEVVDKGASAQSF

IERMTNFDKNLPNEKVLPKHSLLYEYFTVYNELTKVKYVTEGMRKPAFL

SGEQKKAIVDLLFKTNRKVTVKQLKEDYFKKIECFDSVEISGVEDRFNA

SLGTYHDLLKIIKDKDFLDNEENEDILEDIVLTLTLFEDREMIEERLKT

YAHLFDDKVMKQLKRRRYTGWGRLSRKLINGIRDKQSGKTILDFLKSDG

FANRNFMQLIHDDSLTFKEDIQKAQVSGQGDSLHEHIANLAGSPAIKKG

ILQTVKVVDELVKVMGRHKPENIVIEMARENQTTQKGQKNSRERMKRIE

EGIKELGSQILKEHPVENTQLQNEKLYLYYLQNGRDMYVDQELDINRLS

DYDVDHIVPQSFLKDDSIDNKVLTRSDKNRGKSDNVPSEEVVKKMKNYW

RQLLNAKLITQRKFDNLTKAERGGLSELDKAGFIKRQLVETRQITKHVA

QILDSRMNTKYDENDKLIREVKVITLKSKLVSDFRKDFQFYKVREINNY

HHAHDAYLNAVVGTALIKKYPKLESEFVYGDYKVYDVRKMIAKSEQEIG

KATAKYFFYSNIMNFFKTEITLANGEIRKRPLIETNGETGEIVWDKGRD

FATVRKVLSMPQVNIVKKTEVQTGGFSKESILPKRNSDKLIARKKDWDP

KKYGGFDSPTVAYSVLVVAKVEKGKSKKLKSVKELLGITIMERSSFEKN

PIDFLEAKGYKEVKKDLIIKLPKYSLFELENGRKRMLASAGELQKGNEL

ALPSKYVNFLYLASHYEKLKGSPEDNEQKQLFVEQHKHYLDEIIEQISE

FSKRVILADANLDKVLSAYNKHRDKPIREQAENIIHLFTLTNLGAPAAF

KYFDTTIDRKRYTSTKEVLDATLIHQSITGLYETRIDLSQLGGD

Exemplary Catalytically Active Cas9 (SEQ ID NO: 55):

(SEQ ID NO: 55)
DKKYSIGLDIGTNSVGWAVITDEYKVPSKKFKVLGNTDRHSIKKNLIGA

LLFDSGETAEATRLKRTARRRYTRRKNRICYLQEIFSNEMAKVDDSFFH

RLEESFLVEEDKKHERHPIFGNIVDEVAYHEKYPTIYHLRKKLVDSTDK

ADLRLIYLALAHMIKFRGHFLIEGDLNPDNSDVDKLFIQLVQTYNQLFE

ENPINASGVDAKAILSARLSKSRRLENLIAQLPGEKKNGLFGNLIALSL

GLTPNFKSNFDLAEDAKLQLSKDTYDDDLDNLLAQIGDQYADLFLAAKN

LSDAILLSDILRVNTEITKAPLSASMIKRYDEHHQDLTLLKALVRQQLP

EKYKEIFFDQSKNGYAGYIDGGASQEEFYKFIKPILEKMDGTEELLVKL

NREDLLRKQRTFDNGSIPHQIHLGELHAILRRQEDFYPFLKDNREKIEK

ILTFRIPYYVGPLARGNSRFAWMTRKSEETITPWNFEEVVDKGASAQSF

IERMTNFDKNLPNEKVLPKHSLLYEYFTVYNELTKVKYVTEGMRKPAFL

SGEQKKAIVDLLFKTNRKVTVKQLKEDYFKKIECFDSVEISGVEDRFNA

SLGTYHDLLKIIKDKDFLDNEENEDILEDIVLTLTLFEDREMIEERLKT

YAHLFDDKVMKQLKRRRYTGWGRLSRKLINGIRDKQSGKTILDFLKSDG

FANRNFMQLIHDDSLTFKEDIQKAQVSGQGDSLHEHIANLAGSPAIKKG

ILQTVKVVDELVKVMGRHKPENIVIEMARENQTTQKGQKNSRERMKRIE

EGIKELGSQILKEHPVENTQLQNEKLYLYYLQNGRDMYVDQELDINRLS

DYDVDHIVPQSFLKDDSIDNKVLTRSDKNRGKSDNVPSEEVVKKMKNYW

-continued
RQLLNAKLITQRKFDNLTKAERGGLSELDKAGFIKRQLVETRQITKHVA

QILDSRMNTKYDENDKLIREVKVITLKSKLVSDFRKDFQFYKVREINNY

HHAHDAYLNAVVGTALIKKYPKLESEFVYGDYKVYDVRKMIAKSEQEIG

KATAKYFFYSNIMNFFKTEITLANGEIRKRPLIETNGETGEIVWDKGRD

FATVRKVLSMPQVNIVKKTEVQTGGFSKESILPKRNSDKLIARKKDWDP

KKYGGFDSPTVAYSVLVVAKVEKGKSKKLKSVKELLGITIMERSSFEKN

PIDFLEAKGYKEVKKDLIIKLPKYSLFELENGRKRMLASAGELQKGNEL

ALPSKYVNFLYLASHYEKLKGSPEDNEQKQLFVEQHKHYLDEIIEQISE

FSKRVILADANLDKVLSAYNKHRDKPIREQAENIIHLFTLTNLGAPAAF

KYFDTTIDRKRYTSTKEVLDATLIHQSITGLYETRIDLSQLGGD.

In some embodiments, a Cas moiety refers to a Cas9 or Cas9 homolog from archaea (e.g. nanoarchaea), which constitute a domain and kingdom of single-celled prokaryotic microbes. In some embodiments, Cas9 refers to CasX or CasY, which have been described in, for example, Burstein et al., "New CRISPR-Cas systems from uncultivated microbes." *Cell Res.* 2017 Feb. 21. doi: 10.1038/cr.2017.21, the entire contents of which is hereby incorporated by reference. Using genome-resolved metagenomics, a number of CRISPR-Cas systems were identified, including the first reported Cas9 in the archaeal domain of life. This divergent Cas9 protein was found in little-studied nanoarchaea as part of an active CRISPR-Cas system. In bacteria, two previously unknown systems were discovered, CRISPR-CasX and CRISPR-CasY, which are among the most compact systems yet discovered. In some embodiments, Cas9 refers to CasX, or a variant of CasX. In some embodiments, Cas9 refers to a CasY, or a variant of CasY. It should be appreciated that other RNA-guided DNA binding proteins may be used as a nucleic acid programmable DNA binding protein (napDNAbp), and are within the scope of this disclosure.

In some embodiments, the Cas9 moiety is a nucleic acid programmable DNA binding protein (napDNAbp) of any of the fusion proteins provided herein may be a CasX or CasY protein. In some embodiments, the napDNAbp is a CasX protein. In some embodiments, the napDNAbp is a CasY protein. In some embodiments, the napDNAbp comprises an amino acid sequence that is at least 85%, at least 90%, at least 91%, at least 92%, at least 93%, at least 94%, at least 95%, at least 96%, at least 97%, at least 98%, at least 99%, or at least 99.5% identical to a naturally-occurring CasX or CasY protein. In some embodiments, the napDNAbp is a naturally-occurring CasX or CasY protein. In some embodiments, the napDNAbp comprises an amino acid sequence that is at least 85%, at least 90%, at least 91%, at least 92%, at least 93%, at least 94%, at least 95%, at least 96%, at least 97%, at least 98%, at least 99%, or at least 99.5% identical to a wild-type Cas moiety or any Cas moiety provided herein. In some embodiments, the napDNAbp comprises an amino acid sequence of any one of SEQ ID NOs: 56-58. It should be appreciated that CasX and CasY from other bacterial species may also be used in accordance with the present disclosure. These sequences are shown below.

CasX (uniprot.org/uniprot/F0NN87; uniprot.org/uniprot/F0NH53)

>tr|F0NN87|F0NN87_SULIH CRISPR-associated Casx protein OS=*Sulfolobus islandicus* (strain HVE10/4) GN=SiH_0402 PE=4 SV=1

(SEQ ID NO: 56)
MEVPLYNIFGDNYIIQVATEAENSTIYNNKVEIDDEELRNVLNLAYKIA

KNNEDAAAERRGKAKKKKGEEGETTTSNIILPLSGNDKNPWTETLKCYN

FPTTVALSEVFKNFSQVKECEEVSAPSFVKPEFYEFGRSPGMVERTRRV

KLEVEPHYLIIAAAGWVLTRLGKAKVSEGDYVGVNVFTPTRGILYSLIQ

NVNGIVPGIKPETAFGLWIARKVVSSVTNPNVSVVRIYTISDAVGQNPT

TINGGFSIDLTKLLEKRYLLSERLEAIARNALSISSNMRERYIVLANYI

YEYLTGSKRLEDLLYFANRDLIMNLNSDDGKVRDLKLISAYVNGELIRG

EG

CasX OS=*Sulfolobus islandicus* (strain REY15A)
>tr|F0NH53|F0NH53_SULIR CRISPR associated protein, CasX OS=*Sulfolobus islandicus* (strain REY15A) GN=SiRe_0771 PE=4 SV=1

(SEQ ID NO: 57)
MEVPLYNIFGDNYIIQVATEAENSTIYNNKVEIDDEELRNVLNLAYKIA

KNNEDAAAERRGKAKKKKGEEGETTTSNIILPLSGNDKNPWTETLKCYN

FPTTVALSEVFKNFSQVKECEEVSAPSFVKPEFYKFGRSPGMVERTRRV

KLEVEPHYLIMAAAGWVLTRLGKAKVSEGDYVGVNVFTPTRGILYSLIQ

NVNGIVPGIKPETAFGLWIARKVVSSVTNPNVSVVSIYTISDAVGQNPT

TINGGFSIDLTKLLEKRDLLSERLEAIARNALSISSNMRERYIVLANYI

YEYLTGSKRLEDLLYFANRDLIMNLNSDDGKVRDLKLISAYVNGELIRG

EG

CasY (ncbi.nlm.nih.gov/protein/APG80656.1)
>APG80656.1 CRISPR-associated protein CasY [uncultured Parcubacteria group bacterium]

(SEQ ID NO: 58)
MSKRHPRISGVKGYRLHAQRLEYTGKSGAMRTIKYPLYSSPSGGRTVPR

EIVSAINDDYVGLYGLSNFDDLYNAEKRNEEKVYSVLDFWYDCVQYGAV

ESYTAPGLLKNVAEVRGGSYELTKTLKGSHLYDELQIDKVIKFLNKKEI

SRANGSLDKLKKDIIDCFKAEYRERHKDQCNKLADDIKNAKKDAGASLG

ERQKKLFRDFFGISEQSENDKPSFTNPLNLTCCLLPFDTVNNNRNRGEV

LENKLKEYAQKLDKNEGSLEMWEYIGIGNSGTAFSNFLGEGFLGRLREN

KITELKKAMMDITDAWRGQEQEEELEKRLRILAALTIKLREPKFDNHWG

GYRSDINGKLSSWLQNYINQTVKIKEDLKGHKKDLKKAKEMINRFGESD

TKEEAVVSSLLESIEKIVPDDSADDEKPDIPAIAIYRRFLSDGRLTLNR

FVQREDVQEALIKERLEAEKKKPKKRKKKSDAEDEKETIDFKELFPHL

AKPLKLVPNFYGDSKRELYKKYKNAAIYTDALWKAVEKIYKSAFSSSLK

NSFFDTDFDKDFFIKRLQKIFSVYRRFNTDKWKPIVKNSFAPYCDIVSL

AENEVLYKPKQSRSRKSAAIDKNRVRLPSTENIAKAGIALARELSVAGF

DWKDLLKKEEHEEYIDLIELHKTALALLLAVTETQLDISALDFVENGTV

KDFMKTRDGNLVLEGRFLEMFSQSIVFSELRGLAGLMSRKEFITRSAIQ

TMNGKQAELLYIPHEFQSAKITTPKEMSRAFLDLAPAEFATSLEPESLS

EKSLLKLKQMRYYPHYFGYELTRTGQGIDGGVAENALRLEKSPVKKREI

KCKQYKTLGRGQNKIVLYVRSSYYQTQFLEWFLHRPKNVQTDVAVSGSF

LIDEKKVKTRWNYDALTVALEPVSGSERVFVSQPFTIFPEKSAEEEGQR

YLGIDIGEYGIAYTALEITGDSAKILDQNFISDPQLKTLREEVKGLKLD

QRRGTFAMPSTKIARIRESLVHSLRNRIHHLALKHKAKIVYELEVSRFE

EGKQKIKKVYATLKKADVYSEIDADKNLQTTVWGKLAVASEISASYTSQ

FCGACKKLWRAEMQVDETITTQELIGTVRVIKGGTLIDAIKDFMRPPIF

DENDTPFPKYRDFCDKHHISKKMRGNSCLFICPFCRANADADIQASQTI

ALLRYVKEEKKVEDYFE

In various embodiments, the nucleic acid programmable DNA binding proteins include, without limitation, Cas9 (e.g., dCas9 and nCas9), CasX, CasY, Cpf1, C2c1, C2c2, C2C3, and Argonaute. One example of a nucleic acid programmable DNA-binding protein that has different PAM specificity than Cas9 is Clustered Regularly Interspaced Short Palindromic Repeats from *Prevotella* and *Francisella* 1 (Cpf1). Similar to Cas9, Cpf1 is also a class 2 CRISPR effector. It has been shown that Cpf1 mediates robust DNA interference with features distinct from Cas9. Cpf1 is a single RNA-guided endonuclease lacking tracrRNA, and it utilizes a T-rich protospacer-adjacent motif (TTN, TTTN, or YTN). Moreover, Cpf1 cleaves DNA via a staggered DNA double-stranded break. Out of 16 Cpf1-family proteins, two enzymes from Acidaminococcus and Lachnospiraceae are shown to have efficient genome-editing activity in human cells. Cpf1 proteins are known in the art and have been described previously, for example Yamano et al., "Crystal structure of Cpf1 in complex with guide RNA and target DNA." Cell (165) 2016, p. 949-962; the entire contents of which is hereby incorporated by reference.

Also useful in the present compositions and methods are nuclease-inactive Cpf1 (dCpf1) variants that may be used as a guide nucleotide sequence-programmable DNA-binding protein domain. The Cpf1 protein has a RuvC-like endonuclease domain that is similar to the RuvC domain of Cas9 but does not have a HNH endonuclease domain, and the N-terminal of Cpf1 does not have the alfa-helical recognition lobe of Cas9. It was shown in Zetsche et al., Cell, 163, 759-771, 2015 (which is incorporated herein by reference) that, the RuvC-like domain of Cpf1 is responsible for cleaving both DNA strands and inactivation of the RuvC-like domain inactivates Cpf1 nuclease activity. For example, mutations corresponding to D917A, E1006A, or D1255A in *Francisella novicida* Cpf1 (SEQ ID NO: 65) inactivates Cpf1 nuclease activity. In some embodiments, the dCpf1 of the present disclosure comprises mutations corresponding to D917A, E1006A, D1255A, D917A/E1006A, D917A/D1255A, E1006A/D1255A, or D917A/E1006A/D1255A in SEQ ID NO: 59. It is to be understood that any mutations, e.g., substitution mutations, deletions, or insertions that inactivate the RuvC domain of Cpf1, may be used in accordance with the present disclosure.

In some embodiments, the nucleic acid programmable DNA binding protein (napDNAbp) of any of the fusion proteins provided herein may be a Cpf1 protein. In some embodiments, the Cpf1 protein is a Cpf1 nickase (nCpf1). In some embodiments, the Cpf1 protein is a nuclease inactive Cpf1 (dCpf1). In some embodiments, the Cpf1, the nCpf1, or the dCpf1 comprises an amino acid sequence that is at least 85%, at least 90%, at least 91%, at least 92%, at least 93%, at least 94%, at least 95%, at least 96%, at least 97%, at least 98%, at least 99%, or at least 99.5% identical to any one of SEQ ID NOs: 59-66. In some embodiments, the dCpf1 comprises an amino acid sequence that is at least 85%, at least 90%, at least 91%, at least 92%, at least 93%, at least 94%, at least 95%, at least 96%, at least 97%, at least 98%, at least 99%, or at least 99.5% identical to any one of SEQ ID NOs: 59-66, and comprises mutations corresponding to D917A, E1006A, D1255A, D917A/E1006A, D917A/D1255A, E1006A/D1255A, or D917A/E1006A/D1255A in SEQ ID NO: 59. In some embodiments, the dCpf1 comprises an amino acid sequence of any one SEQ ID NOs: 59-66. It should be appreciated that Cpf1 from other bacterial species may also be used in accordance with the present disclosure.

Wild type *Francisella novicida* Cpf1 (SEQ ID NO: 59) (D917, E1006, and D1255 are bolded and underlined)

(SEQ ID NO: 59)
MSIYQEFVNKYSLSKTLRFELIPQGKTLENIKARGLILDDEKRAKDYKK

AKQIIDKYHQFFIEEILSSVCISEDLLQNYSDVYFKLKKSDDDNLQKDF

KSAKDTIKKQISEYIKDSEKFKNLFNQNLIDAKKGQESDLILWLKQSKD

NGIELFKANSDITDIDEALEIIKSFKGWTTYFKGFHENRKNVYSSNDIP

TSIIYRIVDDNLPKFLENKAKYESLKDKAPEAINYEQIKKDLAEELTFD

IDYKTSEVNQRVFSLDEVFEIANFNNYLNQSGITKENTIIGGKFVNGEN

TKRKGINEYINLYSQQINDKTLKKYKMSVLFKQILSDTESKSFVIDKLE

DDSDVVTTMQSFYEQIAAFKTVEEKSIKETLSLLFDDLKAQKLDLSKIY

FKNDKSLTDLSQQVEDDYSVIGTAVLEYITQQIAPKNLDNPSKKEQELI

AKKTEKAKYLSLETIKLALEEFNKHRDIDKQCRFEEILANFAAIPMIFD

EIAQNKDNLAQISIKYQNQGKKDLLQASAEDDVKAIKDLLDQTNNLLHK

LKIFHISQSEDKANILDKDEHFYLVFEECYFELANIVPLYNKIRNYITQ

KPYSDEKFKLNFENSTLANGWDKNKEPDNTAILFIKDDKYYLGVMNKKN

NKIFDDKAIKENKGEGYKKIVYKLLPGANKMLPKVFFSAKSIKFYNPSE

DILRIRNHSTHTKNGSPQKGYEKFEFNIEDCRKFIDFYKQSISKHPEWK

DFGFRFSDTQRYNSIDEFYREVENQGYKLTFENISESYIDSVVNQGKLY

LFQIYNKDFSAYSKGRPNLHTLYWKALFDERNLQDVVYKLNGEAELFYR

KQSIPKKITHPAKEAIANKNKDNPKKESVFEYDLIKDKRFTEDKFFFHC

PITINFKSSGANKENDEINLLLKEKANDVHILSIDRGERHLAYYTLVDG

KGNIIKQDTFNIIGNDRMKTNYHDKLAAIEKDRDSARKDWKKINNIKEM

KEGYLSQVVHEIAKLVIEYNAIVVFEDLNFGFKRGRFKVEKQVYQKLEK

MLIEKLNYLVFKDNEFDKTGGVLRAYQLTAPFETFKKMGKQTGIIYYVP

AGFTSKICPVTGFVNQLYPKYESVSKSQEFFSKFDKICYNLDKGYFEFS

FDYKNFGDKAAKGKWTIASFGSRLINFRNSDKNHNWDTREVYPTKELEK

LLKDYSIEYGHGECIKAAICGESDKKFFAKLTSVLNTILQMRNSKTGTE

LDYLISPVADVNGNFFDSRQAPKNMPQDADANGAYHIGLKGLMLLGRIK

NNQEGKKLNLVIKNEEYFEFVQNRNN

*Francisella novicida* Cpf1 D917A (SEQ ID NO: 60) (A917, E1006, and D1255 are bolded and underlined)

(SEQ ID NO: 60)
MSIYQEFVNKYSLSKTLRFELIPQGKTLENIKARGLILDDEKRAKDYKK

AKQIIDKYHQFFIEEILSSVCISEDLLQNYSDVYFKLKKSDDDNLQKDF

KSAKDTIKKQISEYIKDSEKFKNLFNQNLIDAKKGQESDLILWLKQSKD

NGIELFKANSDITDIDEALEIIKSFKGWTTYFKGFHENRKNVYSSNDIP

TSIIYRIVDDNLPKFLENKAKYESLKDKAPEAINYEQIKKDLAEELTFD

IDYKTSEVNQRVFSLDEVFEIANFNNYLNQSGITKENTIIGGKFVNGEN

TKRKGINEYINLYSQQINDKTLKKYKMSVLFKQILSDTESKSFVIDKLE

DDSDVVTTMQSFYEQIAAFKTVEEKSIKETLSLLFDDLKAQKLDLSKIY

FKNDKSLTDLSQQVEDDYSVIGTAVLEYITQQIAPKNLDNPSKKEQELI

AKKTEKAKYLSLETIKLALEEFNKHRDIDKQCRFEEILANFAAIPMIFD

EIAQNKDNLAQISIKYQNQGKKDLLQASAEDDVKAIKDLLDQTNNLLHK

LKIFHISQSEDKANILDKDEHFYLVFEECYFELANIVPLYNKIRNYITQ

KPYSDEKFKLNFENSTLANGWDKNKEPDNTAILFIKDDKYYLGVMNKKN

NKIFDDKAIKENKGEGYKKIVYKLLPGANKMLPKVFFSAKSIKFYNPSE

DILRIRNHSTHTKNGSPQKGYEKFEFNIEDCRKFIDFYKQSISKHPEWK

DFGFRFSDTQRYNSIDEFYREVENQGYKLTFENISESYIDSVVNQGKLY

LFQIYNKDFSAYSKGRPNLHTLYWKALFDERNLQDVVYKLNGEAELFYR

KQSIPKKITHPAKEAIANKNKDNPKKESVFEYDLIKDKRFTEDKFFFHC

PITINFKSSGANKFNDEINLLLKEKANDVHILSIARGERHLAYYTLVDG

KGNIIKQDTFNIIGNDRMKTNYHDKLAAIEKDRDSARKDWKKINNIKEM

KEGYLSQVVHEIAKLVIEYNAIVVFEDLNFGFKRGRFKVEKQVYQKLEK

MLIEKLNYLVFKDNEFDKTGGVLRAYQLTAPFETFKKMGKQTGIIYYVP

AGFTSKICPVTGFVNQLYPKYESVSKSQEFFSKFDKICYNLDKGYFEFS

FDYKNFGDKAAKGKWTIASFGSRLINFRNSDKNHNWDTREVYPTKELEK

LLKDYSIEYGHGECIKAAICGESDKKFFAKLTSVLNTILQMRNSKTGTE

LDYLISPVADVNGNFFDSRQAPKNMPQDADANGAYHIGLKGLMLLGRIK

NNQEGKKLNLVIKNEEYFEFVQNRNN

*Francisella novicida* Cpf1 E1006A (SEQ ID NO: 61) (D917, A1006, and D1255 are bolded and underlined)

(SEQ ID NO: 61)
MSIYQEFVNKYSLSKTLRFELIPQGKTLENIKARGLILDDEKRAKDYKK

AKQIIDKYHQFFIEEILSSVCISEDLLQNYSDVYFKLKKSDDDNLQKDF

KSAKDTIKKQISEYIKDSEKFKNLFNQNLIDAKKGQESDLILWLKQSKD

NGIELFKANSDITDIDEALEIIKSFKGWTTYFKGFHENRKNVYSSNDIP

TSIIYRIVDDNLPKFLENKAKYESLKDKAPEAINYEQIKKDLAEELTFD

IDYKTSEVNQRVFSLDEVFEIANFNNYLNQSGITKENTIIGGKFVNGEN

TKRKGINEYINLYSQQINDKTLKKYKMSVLFKQILSDTESKSFVIDKLE

DDSDVVTTMQSFYEQIAAFKTVEEKSIKETLSLLFDDLKAQKLDLSKIY

```
FKNDKSLTDLSQQVEDDYSVIGTAVLEYITQQIAPKNLDNPSKKEQELI

AKKTEKAKYLSLETIKLALEEFNKHRDIDKQCRFEEILANFAAIPMIFD

EIAQNKDNLAQISIKYQNQGKKDLLQASAEDDVKAIKDLLDQTNNLLHK

LKIFHISQSEDKANILDKDEHFYLVFEECYFELANIVPLYNKIRNYITQ

KPYSDEKFKLNFENSTLANGWDKNKEPDNTAILFIKDDKYYLGVMNKKN

NKIFDDKAIKENKGEGYKKIVYKLLPGANKMLPKVFFSAKSIKFYNPSE

DILRIRNHSTHTKNGSPQKGYEKFEFNIEDCRKFIDFYKQSISKHPEWK

DFGFRFSDTQRYNSIDEFYREVENQGYKLTFENISESYIDSVVNQGKLY

LFQIYNKDFSAYSKGRPNLHTLYWKALFDERNLQDVVYKLNGEAELFYR

KQSIPKKITHPAKEAIANKNKDNPKKESVFEYDLIKDKRFTEDKFFFHC

PITINFKSSGANKENDEINLLLKEKANDVHILSIDRGERHLAYYTLVDG

KGNIIKQDTFNIIGNDRMKTNYHDKLAAIEKDRDSARKDWKKINNIKEM

KEGYLSQVVHEIAKLVIEYNAIVVFADLNFGFKRGRFKVEKQVYQKLEK

MLIEKLNYLVFKDNEFDKTGGVLRAYQLTAPFETFKKMGKQTGIIYYVP

AGFTSKICPVTGFVNQLYPKYESVSKSQEFFSKFDKICYNLDKGYFEFS

FDYKNFGDKAAKGKWTIASFGSRLINFRNSDKNHNWDTREVYPTKELEK

LLKDYSIEYGHGECIKAAICGESDKKFFAKLTSVLNTILQMRNSKTGTE

LDYLISPVADVNGNFFDSRQAPKNMPQDADANGAYHIGLKGLMLLGRIK

NNQEGKKLNLVIKNEEYFEFVQNRNN
```

*Francisella novicida* Cpf1 D1255A (SEQ ID NO: 62) (D917, E1006, and A1255 are bolded and underlined)

```
                                      (SEQ ID NO: 62)
MSIYQEFVNKYSLSKTLRFELIPQGKTLENIKARGLILDDEKRAKDYKK

AKQIIDKYHQFFIEEILSSVCISEDLLQNYSDVYFKLKKSDDDNLQKDF

KSAKDTIKKQISEYIKDSEKFKNLFNQNLIDAKKGQESDLILWLKQSKD

NGIELFKANSDITDIDEALEIIKSFKGWTTYFKGFHENRKNVYSSNDIP

TSIIYRIVDDNLPKFLENKAKYESLKDKAPEAINYEQIKKDLAEELTFD

IDYKTSEVNQRVFSLDEVFEIANFNNYLNQSGITKENTIIGGKFVNGEN

TKRKGINEYINLYSQQINDKTLKKYKMSVLFKQILSDTESKSFVIDKLE

DDSDVVTTMQSFYEQIAAFKTVEEKSIKETLSLLFDDLKAQKLDLSKIY

FKNDKSLTDLSQQVEDDYSVIGTAVLEYITQQIAPKNLDNPSKKEQELI

AKKTEKAKYLSLETIKLALEEFNKHRDIDKQCRFEEILANFAAIPMIFD

EIAQNKDNLAQISIKYQNQGKKDLLQASAEDDVKAIKDLLDQTNNLLHK

LKIFHISQSEDKANILDKDEHFYLVFEECYFELANIVPLYNKIRNYITQ

KPYSDEKFKLNFENSTLANGWDKNKEPDNTAILFIKDDKYYLGVMNKKN

NKIFDDKAIKENKGEGYKKIVYKLLPGANKMLPKVFFSAKSIKFYNPSE

DILRIRNHSTHTKNGSPQKGYEKFEFNIEDCRKFIDFYKQSISKHPEWK

DFGFRFSDTQRYNSIDEFYREVENQGYKLTFENISESYIDSVVNQGKLY

LFQIYNKDFSAYSKGRPNLHTLYWKALFDERNLQDVVYKLNGEAELFYR

KQSIPKKITHPAKEAIANKNKDNPKKESVFEYDLIKDKRFTEDKFFFHC

PITINFKSSGANKENDEINLLLKEKANDVHILSIDRGERHLAYYTLVDG

KGNIIKQDTFNIIGNDRMKTNYHDKLAAIEKDRDSARKDWKKINNIKEM

KEGYLSQVVHEIAKLVIEYNAIVVFEDLNFGFKRGRFKVEKQVYQKLEK

MLIEKLNYLVFKDNEFDKTGGVLRAYQLTAPFETFKKMGKQTGIIYYVP

AGFTSKICPVTGFVNQLYPKYESVSKSQEFFSKFDKICYNLDKGYFEFS

FDYKNFGDKAAKGKWTIASFGSRLINFRNSDKNHNWDTREVYPTKELEK

LLKDYSIEYGHGECIKAAICGESDKKFFAKLTSVLNTILQMRNSKTGTE

LDYLISPVADVNGNFFDSRQAPKNMPQDAAANGAYHIGLKGLMLLGRIK

NNQEGKKLNLVIKNEEYFEFVQNRNN
```

*Francisella novicida* Cpf1 D917A/E1006A (SEQ ID NO: 63) (A917, A1006, and D1255 are bolded and underlined)

```
                                      (SEQ ID NO: 63)
MSIYQEFVNKYSLSKTLRFELIPQGKTLENIKARGLILDDEKRAKDYKK

AKQIIDKYHQFFIEEILSSVCISEDLLQNYSDVYFKLKKSDDDNLQKDF

KSAKDTIKKQISEYIKDSEKFKNLFNQNLIDAKKGQESDLILWLKQSKD

NGIELFKANSDITDIDEALEIIKSFKGWTTYFKGFHENRKNVYSSNDIP

TSIIYRIVDDNLPKFLENKAKYESLKDKAPEAINYEQIKKDLAEELTFD

IDYKTSEVNQRVFSLDEVFEIANFNNYLNQSGITKENTIIGGKFVNGEN

TKRKGINEYINLYSQQINDKTLKKYKMSVLFKQILSDTESKSFVIDKLE

DDSDVVTTMQSFYEQIAAFKTVEEKSIKETLSLLFDDLKAQKLDLSKIY

FKNDKSLTDLSQQVEDDYSVIGTAVLEYITQQIAPKNLDNPSKKEQELI

AKKTEKAKYLSLETIKLALEEFNKHRDIDKQCRFEEILANFAAIPMIFD

EIAQNKDNLAQISIKYQNQGKKDLLQASAEDDVKAIKDLLDQTNNLLHK

LKIFHISQSEDKANILDKDEHFYLVFEECYFELANIVPLYNKIRNYITQ

KPYSDEKFKLNFENSTLANGWDKNKEPDNTAILFIKDDKYYLGVMNKKN

NKIFDDKAIKENKGEGYKKIVYKLLPGANKMLPKVFFSAKSIKFYNPSE

DILRIRNHSTHTKNGSPQKGYEKFEFNIEDCRKFIDFYKQSISKHPEWK

DFGFRFSDTQRYNSIDEFYREVENQGYKLTFENISESYIDSVVNQGKLY

LFQIYNKDFSAYSKGRPNLHTLYWKALFDERNLQDVVYKLNGEAELFYR

KQSIPKKITHPAKEAIANKNKDNPKKESVFEYDLIKDKRFTEDKFFFHC

PITINFKSSGANKENDEINLLLKEKANDVHILSIARGERHLAYYTLVDG

KGNIIKQDTFNIIGNDRMKTNYHDKLAAIEKDRDSARKDWKKINNIKEM

KEGYLSQVVHEIAKLVIEYNAIVVFADLNFGFKRGRFKVEKQVYQKLEK

MLIEKLNYLVFKDNEFDKTGGVLRAYQLTAPFETFKKMGKQTGIIYYVP

AGFTSKICPVTGFVNQLYPKYESVSKSQEFFSKFDKICYNLDKGYFEFS

FDYKNFGDKAAKGKWTIASFGSRLINFRNSDKNHNWDTREVYPTKELEK

LLKDYSIEYGHGECIKAAICGESDKKFFAKLTSVLNTILQMRNSKTGTE

LDYLISPVADVNGNFFDSRQAPKNMPQDADANGAYHIGLKGLMLLGRIK

NNQEGKKLNLVIKNEEYFEFVQNRNN
```

*Francisella novicida* Cpf1 D917A/D1255A (SEQ ID NO: 64) (A917, E1006, and A1255 are bolded and underlined)

(SEQ ID NO: 64)
MSIYQEFVNKYSLSKTLRFELIPQGKTLENIKARGLILDDEKRAKDYKK
AKQIIDKYHQFFIEEILSSVCISEDLLQNYSDVYFKLKKSDDDNLQKDF
KSAKDTIKKQISEYIKDSEKFKNLFNQNLIDAKKGQESDLILWLKQSKD
NGIELFKANSDITDIDEALEIIKSFKGWTTYFKGFHENRKNVYSSNDIP
TSIIYRIVDDNLPKFLENKAKYESLKDKAPEAINYEQIKKDLAEELTFD
IDYKTSEVNQRVFSLDEVFEIANFNNYLNQSGITKENTIIGGKFVNGEN
TKRKGINEYINLYSQQINDKTLKKYKMSVLFKQILSDTESKSFVIDKLE
DDSDVVTTMQSFYEQIAAFKTVEEKSIKETLSLLFDDLKAQKLDLSKIY
FKNDKSLTDLSQQVEDDYSVIGTAVLEYITQQIAPKNLDNPSKKEQELI
AKKTEKAKYLSLETIKLALEEFNKHRDIDKQCRFEEILANFAAIPMIFD
EIAQNKDNLAQISIKYQNQGKKDLLQASAEDDVKAIKDLLDQTNNLLHK
LKIFHISQSEDKANILDKDEHFYLVFEECYFELANIVPLYNKIRNYITQ
KPYSDEKFKLNFENSTLANGWDKNKEPDNTAILFIKDDKYYLGVMNKKN
NKIFDDKAIKENKGEGYKKIVYKLLPGANKMLPKVFFSAKSIKFYNPSE
DILRIRNHSTHTKNGSPQKGYEKFEFNIEDCRKFIDFYKQSISKHPEWK
DFGFRFSDTQRYNSIDEFYREVENQGYKLTFENISESYIDSVVNQGKLY
LFQIYNKDFSAYSKGRPNLHTLYWKALFDERNLQDVVYKLNGEAELFYR
KQSIPKKITHPAKEAIANKNKDNPKKESVFEYDLIKDKRFTEDKFFFHC
PITINFKSSGANKENDEINLLLKEKANDVHILSIARGERHLAYYTLVDG
KGNIIKQDTFNIIGNDRMKTNYHDKLAAIEKDRDSARKDWKKINNIKEM
KEGYLSQVVHEIAKLVIEYNAIVVFEDLNFGFKRGRFKVEKQVYQKLEK
MLIEKLNYLVFKDNEFDKTGGVLRAYQLTAPFETFKKMGKQTGIIYYVP
AGFTSKICPVTGFVNQLYPKYESVSKSQEFFSKFDKICYNLDKGYFEFS
FDYKNFGDKAAKGKWTIASFGSRLINFRNSDKNHNWDTREVYPTKELEK
LLKDYSIEYGHGECIKAAICGESDKKFFAKLTSVLNTILQMRNSKTGTE
LDYLISPVADVNGNFFDSRQAPKNMPQDAAANGAYHIGLKGLMLLGRIK
NNQEGKKLNLVIKNEEYFEFVQNRNN

*Francisella novicida* Cpf1 E1006A/D1255A (SEQ ID NO: 65) (D917, A1006, and A1255 are bolded and underlined)

(SEQ ID NO: 65)
MSIYQEFVNKYSLSKTLRFELIPQGKTLENIKARGLILDDEKRAKDYKK
AKQIIDKYHQFFIEEILSSVCISEDLLQNYSDVYFKLKKSDDDNLQKDF
KSAKDTIKKQISEYIKDSEKFKNLFNQNLIDAKKGQESDLILWLKQSKD
NGIELFKANSDITDIDEALEIIKSFKGWTTYFKGFHENRKNVYSSNDIP
TSIIYRIVDDNLPKFLENKAKYESLKDKAPEAINYEQIKKDLAEELTFD
IDYKTSEVNQRVFSLDEVFEIANFNNYLNQSGITKENTIIGGKFVNGEN
TKRKGINEYINLYSQQINDKTLKKYKMSVLFKQILSDTESKSFVIDKLE
DDSDVVTTMQSFYEQIAAFKTVEEKSIKETLSLLFDDLKAQKLDLSKIY
FKNDKSLTDLSQQVEDDYSVIGTAVLEYITQQIAPKNLDNPSKKEQELI
AKKTEKAKYLSLETIKLALEEFNKHRDIDKQCRFEEILANFAAIPMIFD

-continued

EIAQNKDNLAQISIKYQNQGKKDLLQASAEDDVKAIKDLLDQTNNLLHK
LKIFHISQSEDKANILDKDEHFYLVFEECYFELANIVPLYNKIRNYITQ
KPYSDEKFKLNFENSTLANGWDKNKEPDNTAILFIKDDKYYLGVMNKKN
NKIFDDKAIKENKGEGYKKIVYKLLPGANKMLPKVFFSAKSIKFYNPSE
DILRIRNHSTHTKNGSPQKGYEKFEFNIEDCRKFIDFYKQSISKHPEWK
DFGFRFSDTQRYNSIDEFYREVENQGYKLTFENISESYIDSVVNQGKLY
LFQIYNKDFSAYSKGRPNLHTLYWKALFDERNLQDVVYKLNGEAELFYR
KQSIPKKITHPAKEAIANKNKDNPKKESVFEYDLIKDKRFTEDKFFFHC
PITINFKSSGANKENDEINLLLKEKANDVHILSIDRGERHLAYYTLVDG
KGNIIKQDTFNIIGNDRMKTNYHDKLAAIEKDRDSARKDWKKINNIKEM
KEGYLSQVVHEIAKLVIEYNAIVVFADLNFGFKRGRFKVEKQVYQKLEK
MLIEKLNYLVFKDNEFDKTGGVLRAYQLTAPFETFKKMGKQTGIIYYVP
AGFTSKICPVTGFVNQLYPKYESVSKSQEFFSKFDKICYNLDKGYFEFS
FDYKNFGDKAAKGKWTIASFGSRLINFRNSDKNHNWDTREVYPTKELEK
LLKDYSIEYGHGECIKAAICGESDKKFFAKLTSVLNTILQMRNSKTGTE
LDYLISPVADVNGNFFDSRQAPKNMPQDAAANGAYHIGLKGLMLLGRIK
NNQEGKKLNLVIKNEEYFEFVQNRNN

*Francisella novicida* Cpf1 D917A/E1006A/D1255A (SEQ ID NO: 66) (A917, A1006, and A1255 are bolded and underlined)

(SEQ ID NO: 66)
MSIYQEFVNKYSLSKTLRFELIPQGKTLENIKARGLILDDEKRAKDYKK
AKQIIDKYHQFFIEEILSSVCISEDLLQNYSDVYFKLKKSDDDNLQKDF
KSAKDTIKKQISEYIKDSEKFKNLFNQNLIDAKKGQESDLILWLKQSKD
NGIELFKANSDITDIDEALEIIKSFKGWTTYFKGFHENRKNVYSSNDIP
TSIIYRIVDDNLPKFLENKAKYESLKDKAPEAINYEQIKKDLAEELTFD
IDYKTSEVNQRVFSLDEVFEIANFNNYLNQSGITKENTIIGGKFVNGEN
TKRKGINEYINLYSQQINDKTLKKYKMSVLFKQILSDTESKSFVIDKLE
DDSDVVTTMQSFYEQIAAFKTVEEKSIKETLSLLFDDLKAQKLDLSKIY
FKNDKSLTDLSQQVEDDYSVIGTAVLEYITQQIAPKNLDNPSKKEQELI
AKKTEKAKYLSLETIKLALEEFNKHRDIDKQCRFEEILANFAAIPMIFD
EIAQNKDNLAQISIKYQNQGKKDLLQASAEDDVKAIKDLLDQTNNLLHK
LKIFHISQSEDKANILDKDEHFYLVFEECYFELANIVPLYNKIRNYITQ
KPYSDEKFKLNFENSTLANGWDKNKEPDNTAILFIKDDKYYLGVMNKKN
NKIFDDKAIKENKGEGYKKIVYKLLPGANKMLPKVFFSAKSIKFYNPSE
DILRIRNHSTHTKNGSPQKGYEKFEFNIEDCRKFIDFYKQSISKHPEWK
DFGFRFSDTQRYNSIDEFYREVENQGYKLTFENISESYIDSVVNQGKLY
LFQIYNKDFSAYSKGRPNLHTLYWKALFDERNLQDVVYKLNGEAELFYR
KQSIPKKITHPAKEAIANKNKDNPKKESVFEYDLIKDKRFTEDKFFFHC
PITINFKSSGANKENDEINLLLKEKANDVHILSIARGERHLAYYTLVDG
KGNIIKQDTFNIIGNDRMKTNYHDKLAAIEKDRDSARKDWKKINNIKEM

KEGYLSQVVHEIAKLVIEYNAIVVFADLNFGFKRGRFKVEKQVYQKLEK

MLIEKLNYLVFKDNEFDKTGGVLRAYQLTAPFETFKKMGKQTGIIYYVP

AGFTSKICPVTGFVNQLYPKYESVSKSQEFFSKFDKICYNLDKGYFEFS

FDYKNFGDKAAKGKWTIASFGSRLINFRNSDKNHNWDTREVYPTKELEK

LLKDYSIEYGHGECIKAAICGESDKKFFAKLTSVLNTILQMRNSKTGTE

LDYLISPVADVNGNFFDSRQAPKNMPQDAAANGAYHIGLKGLMLLGRIK

NNQEGKKLNLVIKNEEYFEFVQNRMN

In some embodiments, the nucleic acid programmable DNA binding protein (napDNAbp) is a nucleic acid programmable DNA binding protein that does not require a canonical (NGG) PAM sequence. In some embodiments, the napDNAbp is an argonaute protein. One example of such a nucleic acid programmable DNA binding protein is an Argonaute protein from *Natronobacterium gregoryi* (NgAgo). NgAgo is a ssDNA-guided endonuclease. NgAgo binds 5' phosphorylated ssDNA of ~24 nucleotides (gDNA) to guide it to its target site and will make DNA double-strand breaks at the gDNA site. In contrast to Cas9, the NgAgo-gDNA system does not require a protospacer-adjacent motif (PAM). Using a nuclease inactive NgAgo (dNgAgo) can greatly expand the bases that may be targeted. The characterization and use of NgAgo have been described in Gao et al., *Nat Biotechnol.*, 2016 July; 34(7):768-73. PubMed PMID: 27136078; Swarts et al., *Nature.* 507(7491) (2014): 258-61; and Swarts et al., *Nucleic Acids Res.* 43(10) (2015): 5120-9, each of which is incorporated herein by reference. The sequence of *Natronobacterium gregoryi* Argonaute is provided in SEQ ID NO: 67.

Wild type *Natronobacterium gregoryi* Argonaute (SEQ ID NO: 67)

(SEQ ID NO: 67)
MTVIDLDSTTTADELTSGHTYDISVTLTGVYDNTDEQHPRMSLAFEQDN

GERRYITLWKNTTPKDVFTYDYATGSTYIFTNIDYEVKDGYENLTATYQ

TTVENATAQEVGTTDEDETFAGGEPLDHHLDDALNETPDDAETESDSGH

VMTSFASRDQLPEWTLHTYTLTATDGAKTDTEYARRTLAYTVRQELYTD

HDAAPVATDGLMLLTPEPLGETPLDLDCGVRVEADETRTLDYTTAKDRL

LARELVEEGLKRSLWDDYLVRGIDEVLSKEPVLTCDEFDLHERYDLSVE

VGHSGRAYLHINFRHRFVPKLTLADIDDDNIYPGLRVKTTYRPRRGHIV

WGLRDECATDSLNTLGNQSVVAYHRNNQTPINTDLLDAIEAADRRVVET

RRQGHGDDAVSFPQELLAVEPNTHQIKQFASDGFHQQARSKTRLSASRC

SEKAQAFAERLDPVRLNGSTVEFSSEFFTGNNEQQLRLLYENGESVLTF

RDGARGAHPDETFSKGIVNPPESFEVAVVLPEQQADTCKAQWDTMADLL

NQAGAPPTRSETVQYDAFSSPESISLNVAGAIDPSEVDAAFVVLPPDQE

GFADLASPTETYDELKKALANMGIYSQMAYFDRFRDAKIFYTRNVALGL

LAAAGGVAFTTEHAMPGDADMFIGIDVSRSYPEDGASGQINIAATATAV

YKDGTILGHSSTRPQLGEKLQSTDVRDIMKNAILGYQQVTGESPTHIVI

HRDGFMNEDLDPATEFLNEQGVEYDIVEIRKQPQTRLLAVSDVQYDTPV

KSIAAINQNEPRATVATFGAPEYLATRDGGGLPRPIQIERVAGETDIET

LTRQVYLLSQSHIQVHNSTARLPITTAYADQASTHATKGYLVQTGAFES

NVGFL

In some embodiments, the napDNAbp is a prokaryotic homolog of an Argonaute protein. Prokaryotic homologs of Argonaute proteins are known and have been described, for example, in Makarova K., et al., "Prokaryotic homologs of Argonaute proteins are predicted to function as key components of a novel system of defense against mobile genetic elements", *Biol Direct.* 2009 Aug. 25; 4:29. doi: 10.1186/1745-6150-4-29, the entire contents of which is hereby incorporated by reference. In some embodiments, the napDNAbp is a *Marinitoga piezophila* Argunaute (MpAgo) protein. The CRISPR-associated *Marinitoga piezophila* Argunaute (MpAgo) protein cleaves single-stranded target sequences using 5'-phosphorylated guides. The 5' guides are used by all known Argonautes. The crystal structure of an MpAgo-RNA complex shows a guide strand binding site comprising residues that block 5' phosphate interactions. This data suggests the evolution of an Argonaute subclass with noncanonical specificity for a 5'-hydroxylated guide. See, e.g., Kaya et al., "A bacterial Argonaute with noncanonical guide RNA specificity", *Proc Natl Acad Sci USA.* 2016 Apr. 12; 113(15):4057-62, the entire contents of which are hereby incorporated by reference). It should be appreciated that other argonaute proteins may be used, and are within the scope of this disclosure.

In some embodiments, the nucleic acid programmable DNA binding protein (napDNAbp) is a single effector of a microbial CRISPR-Cas system. Single effectors of microbial CRISPR-Cas systems include, without limitation, Cas9, Cpf1, C2c1, C2c2, and C2c3. Typically, microbial CRISPR-Cas systems are divided into Class 1 and Class 2 systems. Class 1 systems have multisubunit effector complexes, while Class 2 systems have a single protein effector. For example, Cas9 and Cpf1 are Class 2 effectors. In addition to Cas9 and Cpf1, three distinct Class 2 CRISPR-Cas systems (C2c1, C2c2, and C2c3) have been described by Shmakov et al., "Discovery and Functional Characterization of Diverse Class 2 CRISPR Cas Systems", *Mol. Cell,* 2015 Nov. 5; 60(3): 385-397, the entire contents of which is hereby incorporated by reference. Effectors of two of the systems, C2c1 and C2c3, contain RuvC-like endonuclease domains related to Cpf1. A third system, C2c2 contains an effector with two predicated HEPN RNase domains. Production of mature CRISPR RNA is tracrRNA-independent, unlike production of CRISPR RNA by C2c1. C2c1 depends on both CRISPR RNA and tracrRNA for DNA cleavage. Bacterial C2c2 has been shown to possess a unique RNase activity for CRISPR RNA maturation distinct from its RNA-activated single-stranded RNA degradation activity. These RNase functions are different from each other and from the CRISPR RNA-processing behavior of Cpf1. See, e.g., East-Seletsky, et al., "Two distinct RNase activities of CRISPR-C2c2 enable guide-RNA processing and RNA detection", *Nature,* 2016 Oct. 13; 538(7624):270-273, the entire contents of which are hereby incorporated by reference. In vitro biochemical analysis of C2c2 in *Leptotrichia shahii* has shown that C2c2 is guided by a single CRISPR RNA and can be programed to cleave ssRNA targets carrying complementary protospacers. Catalytic residues in the two conserved HEPN domains mediate cleavage. Mutations in the catalytic residues generate catalytically inactive RNA-binding proteins. See e.g., Abudayyeh et al., "C2c2 is a single-component programmable RNA-guided RNA-targeting CRISPR effector", *Science,* 2016 Aug. 5; 353(6299), the entire contents of which are hereby incorporated by reference.

The crystal structure of *Alicyclobacillus acidoterrestris* C2c1 (AacC2c1) has been reported in complex with a chimeric single-molecule guide RNA (sgRNA). See e.g., Liu et al., "C2c1-sgRNA Complex Structure Reveals RNA-Guided DNA Cleavage Mechanism", *Mol. Cell,* 2017 Jan. 19; 65(2):310-322, the entire contents of which are hereby incorporated by reference. The crystal structure has also been reported in *Alicyclobacillus acidoterrestris* C2c1 bound to target DNAs as ternary complexes. See e.g., Yang et al., "PAM-dependent Target DNA Recognition and Cleavage by C2C1 CRISPR-Cas endonuclease", *Cell,* 2016 Dec. 15; 167(7):1814-1828, the entire contents of which are hereby incorporated by reference. Catalytically competent conformations of AacC2c1, both with target and non-target DNA strands, have been captured independently positioned within a single RuvC catalytic pocket, with C2c1-mediated cleavage resulting in a staggered seven-nucleotide break of target DNA. Structural comparisons between C2c1 ternary complexes and previously identified Cas9 and Cpf1 counterparts demonstrate the diversity of mechanisms used by CRISPR-Cas9 systems.

In some embodiments, the nucleic acid programmable DNA binding protein (napDNAbp) of any of the fusion proteins provided herein may be a C2c1, a C2c2, or a C2c3 protein. In some embodiments, the napDNAbp is a C2c1 protein. In some embodiments, the napDNAbp is a C2c2 protein. In some embodiments, the napDNAbp is a C2c3 protein. In some embodiments, the napDNAbp comprises an amino acid sequence that is at least 85%, at least 90%, at least 91%, at least 92%, at least 93%, at least 94%, at least 95%, at least 96%, at least 97%, at least 98%, at least 99%, or at least 99.5% identical to a naturally-occurring C2c1, C2c2, or C2c3 protein. In some embodiments, the napDNAbp is a naturally-occurring C2c1, C2c2, or C2c3 protein. In some embodiments, the napDNAbp comprises an amino acid sequence that is at least 85%, at least 90%, at least 91%, at least 92%, at least 93%, at least 94%, at least 95%, at least 96%, at least 97%, at least 98%, at least 99%, or at least 99.5% identical to any one of SEQ ID NOs: 68 or 69. In some embodiments, the napDNAbp comprises an amino acid sequence of any one SEQ ID NOs: 68 or 69. It should be appreciated that C2c1, C2c2, or C2c3 from other bacterial species may also be used in accordance with the present disclosure.

C2c1 (uniprot.org/uniprot/T0D7A2 #)
sp|T0D7A2|C2C1_ALIAG CRISPR-associated endonuclease C2c1 OS=*Alicyclobacillus acidoterrestris* (strain ATCC 49025/DSM 3922/CIP 106132/NCIMB 13137/GD3B) GN=c2c1 PE=1 SV=1

```
                                          (SEQ ID NO: 68)
MAVKSIKVKLRLDDMPEIRAGLWKLHKEVNAGVRYYTEWLSLLRQENLY

RRSPNGDGEQECDKTAEECKAELLERLRARQVENGHRGPAGSDDELLQL

ARQLYELLVPQAIGAKGDAQQIARKFLSPLADKDAVGGLGIAKAGNKPR

WVRMREAGEPGWEEEKEKAETRKSADRTADVLRALADFGLKPLMRVYTD

SEMSSVEWKPLRKGQAVRTWDRDMFQQAIERMMSWESWNQRVGQEYAKL

VEQKNRFEQKNFVGQEHLVHLVNQLQQDMKEASPGLESKEQTAHYVTGR

ALRGSDKVFEKWGKLAPDAPFDLYDAEIKNVQRRNTRRFGSHDLFAKLA

EPEYQALWREDASFLTRYAVYNSILRKLNHAKMFATFTLPDATAHPIWT

RFDKLGGNLHQYTFLFNEFGERRHAIRFHKLLKVENGVAREVDDVTVPI

SMSEQLDNLLPRDPNEPIALYFRDYGAEQHFTGEFGGAKIQCRRDQLAH

MHRRRGARDVYLNVSVRVQSQSEARGERRPPYAAVFRLVGDNHRAFVHF

DKLSDYLAEHPDDGKLGSEGLLSGLRVMSVDLGLRTSASISVFRVARKD

ELKPNSKGRVPFFFPIKGNDNLVAVHERSQLLKLPGETESKDLRAIREE

RQRTLRQLRTQLAYLRLLVRCGSEDVGRRERSWAKLIEQPVDAANHMTP

DWREAFENELQKLKSLHGICSDKEWMDAVYESVRRVWRHMGKQVRDWRK

DVRSGERPKIRGYAKDVVGGNSIEQIEYLERQYKFLKSWSFFGKVSGQV

IRAEKGSRFAITLREHIDHAKEDRLKKLADRIIMEALGYVYALDERGKG

KWVAKYPPCQLILLEELSEYQFNNDRPPSENNQLMQWSHRGVFQELINQ

AQVHDLLVGTMYAAFSSRFDARTGAPGIRCRRVPARCTQEHNPEPFPWW

LNKFVVEHTLDACPLRADDLIPTGEGEIFVSPFSAEEGDFHQIHADLNA

AQNLQQRLWSDFDISQIRLRCDWGEVDGELVLIPRLTGKRTADSYSNKV

FYTNTGVTYYERERGKKRRKVFAQEKLSEEEAELLVEADEAREKSVVLM

RDPSGIINRGNWTRQKEFWSMVNQRIEGYLVKQIRSRVPLQDSACENTG

DI
```

C2c2 (uniprot.org/uniprot/P0DOC6)
>sp|P0DOC6|C2C2_LEPSD CRISPR-associated endoribonuclease C2c2 OS=*Leptotrichia shahii* (strain DSM 19757/CCUG 47503/CIP 107916/JCM 16776/LB37) GN=c2c2 PE=1 SV=1

```
                                          (SEQ ID NO: 69)
MGNLFGHKRWYEVRDKKDFKIKRKVKVKRNYDGNKYILNINENNNKEKI

DNNKFIRKYINYKKNDNILKEFTRKFHAGNILFKLKGKEGIIRIENNDD

FLETEEVVLYIEAYGKSEKLKALGITKKKIIDEAIRQGITKDDKKIEIK

RQENEEEIEIDIRDEYTNKTLNDCSIILRIIENDELETKKSIYEIFKNI

NMSLYKIIEKIIENETEKVFENRYYEEHLREKLLKDDKIDVILTNFMEI

REKIKSNLEILGFVKFYLNVGGDKKKSKNKKMLVEKILNINVDLTVEDI

ADFVIKELEFWNITKRIEKVKKVNNEFLEKRRNRTYIKSYVLLDKHEKF

KIERENKKDKIVKFFVENIKNNSIKEKIEKILAEFKIDELIKKLEKELK

KGNCDTEIFGIFKKHYKVNFDSKKFSKKSDEEKELYKIIYRYLKGRIEK

ILVNEQKVRLKKMEKIEIEKILNESILSEKILKRVKQYTLEHIMYLGKL

RHNDIDMTTVNTDDFSRLHAKEELDLELITFFASTNMELNKIFSRENIN

NDENIDFFGGDREKNYVLDKKILNSKIKIIRDLDFIDNKNNITNNFIRK

FTKIGTNERNRILHAISKERDLQGTQDDYNKVINIIQNLKISDEEVSKA

LNLDVVFKDKKNIITKINDIKISEENNNDIKYLPSFSKVLPEILNLYRN

NPKNEPFDTIETEKIVLNALIYVNKELYKKLILEDDLEENESKNIFLQE

LKKTLGNIDEIDENIIENYYKNAQISASKGNNKAIKKYQKKVIECYIGY

LRKNYEELFDFSDFKMNIQEIKKQIKDINDNKTYERITVKTSDKTIVIN

DDFEYIISIFALLNSNAVINKIRNRFFATSVWLNTSEYQNIIDILDEIM

QLNTLRNECITENWNLNLEEFIQKMKEIEKDFDDFKIQTKKEIFNNYYE
```

```
DIKNNILTEFKDDINGCDVLEKKLEKIVIFDDETKFEIDKKSNILQDEQ

RKLSNINKKDLKKKVDQYIKDKDQEIKSKILCRIIFNSDFLKKYKKEID

NLIEDMESENENKFQEIYYPKERKNELYIYKKNLFLNIGNPNFDKIYGL

ISNDIKMADAKFLFNIDGKNIRKNKISEIDAILKNLNDKLNGYSKEYKE

KYIKKLKENDDFFAKNIQNKNYKSFEKDYNRVSEYKKIRDLVEFNYLNK

IESYLIDINWKLAIQMARFERDMHYIVNGLRELGIIKLSGYNTGISRAY

PKRNGSDGFYTTTAYYKFFDEESYKKFEKICYGFGIDLSENSEINKPEN

ESIRNYISHFYIVRNPFADYSIAEQIDRVSNLLSYSTRYNNSTYASVFE

VFKKDVNLDYDELKKKFKLIGNNDILERLMKPKKVSVLELESYNSDYIK

NLIIELLTKIENTNDTL
```

Cas9 Domains with Reduced PAM Exclusivity

Some aspects of the disclosure provide Cas9 domains that have different PAM specificities. Typically, Cas9 proteins, such as Cas9 from *S. pyogenes* (spCas9), require a canonical NGG PAM sequence to bind a particular nucleic acid region. This may limit the ability to edit desired bases within a genome. In some embodiments, the base editing fusion proteins provided herein may need to be placed at a precise location, for example where a target base is placed within a 4 base region (e.g., a "deamination window"), which is approximately 15 bases upstream of the PAM. See Komor, A. C., et al., "Programmable editing of a target base in genomic DNA without double-stranded DNA cleavage" *Nature* 533, 420-424 (2016), the entire contents of which are hereby incorporated by reference. Accordingly, in some embodiments, any of the fusion proteins provided herein may contain a Cas9 domain that is capable of binding a nucleotide sequence that does not contain a canonical (e.g., NGG) PAM sequence. Cas9 domains that bind to non-canonical PAM sequences have been described in the art and would be apparent to the skilled artisan. For example, Cas9 domains that bind non-canonical PAM sequences have been described in Kleinstiver, B. P., et al., "Engineered CRISPR-Cas9 nucleases with altered PAM specificities" *Nature* 523, 481-485 (2015); and Kleinstiver, B. P., et al., "Broadening the targeting range of *Staphylococcus aureus* CRISPR-Cas9 by modifying PAM recognition" *Nature Biotechnology* 33, 1293-1298 (2015); the entire contents of each are hereby incorporated by reference.

In some embodiments, the Cas9 domain is a Cas9 domain from *Staphylococcus aureus* (SaCas9). In some embodiments, the SaCas9 domain is a nuclease active SaCas9, a nuclease inactive SaCas9 (SaCas9d), or a SaCas9 nickase (SaCas9n). In some embodiments, the SaCas9 comprises the amino acid sequence SEQ ID NO: 70. In some embodiments, the SaCas9 comprises a N579X mutation of SEQ ID NO: 70, wherein X is any amino acid except for N. In some embodiments, the SaCas9 comprises a N579A mutation of SEQ ID NO: 70. In some embodiments, the SaCas9 domain, the SaCas9d domain, or the SaCas9n domain can bind to a nucleic acid sequence having a non-canonical PAM. In some embodiments, the SaCas9 domain, the SaCas9d domain, or the SaCas9n domain can bind to a nucleic acid sequence having a NNGRRT PAM sequence. In some embodiments, the SaCas9 domain comprises one or more of a E781X, a N967X, and a R1014X mutation of SEQ ID NO: 70, wherein X is any amino acid. In some embodiments, the SaCas9 domain comprises one or more of a E781K, a N967K, and a R1014H mutation of SEQ ID NO: 70. In some embodiments, the SaCas9 domain comprises a E781K, a N967K, or a R1014H mutation of SEQ ID NO: 70.

In some embodiments, the Cas9 domain of any of the fusion proteins provided herein comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to SEQ ID NO: 70. In some embodiments, the Cas9 domain of any of the fusion proteins provided herein comprises the amino acid sequence of SEQ ID NOs: 70. In some embodiments, the Cas9 domain of any of the fusion proteins provided herein consists of the amino acid sequence of SEQ ID NOs: 70.

Exemplary SaCas9 Sequence

```
                                        (SEQ ID NO: 70)
KRNYILGLDIGITSVGYGIIDYETRDVIDAGVRLFKEANVENNEGRRSK

RGARRLKRRRRHRIQRVKKLLFDYNLLTDHSELSGINPYEARVKGLSQK

LSEEEFSAALLHLAKRRGVHNVNEVEEDTGNELSTKEQISRNSKALEEK

YVAELQLERLKKDGEVRGSINRFKTSDYVKEAKQLLKVQKAYHQLDQSF

IDTYIDLLETRRTYYEGPGEGSPFGWKDIKEWYEMLMGHCTYFPEELRS

VKYAYNADLYNALNDLNNLVITRDENEKLEYYEKFQIIENVFKQKKKPT

LKQIAKEILVNEEDIKGYRVTSTGKPEFTNLKVYHDIKDITARKEIIEN

AELLDQIAKILTIYQSSEDIQEELTNLNSELTQEEIEQISNLKGYTGTH

NLSLKAINLILDELWHTNDNQIAIFNRLKLVPKKVDLSQQKEIPTTLVD

DFILSPVVKRSFIQSIKVINAIIKKYGLPNDIIIELAREKNSKDAQKMI

NEMQKRNRQTNERIEEIIRTTGKENAKYLIEKIKLHDMQEGKCLYSLEA

IPLEDLLNNPFNYEVDHIIPRSVSFDNSFNNKVLVKQEENSKKGNRTPF

QYLSSSDSKISYETFKKHILNLAKGKGRISKTKKEYLLEERDINRFSVQ

KDFINRNLVDTRYATRGLMNLLRSYFRVNNLDVKVKSINGGFTSFLRRK

WKFKKERNKGYKHHAEDALIIANADFIFKEWKKLDKAKKVMENQMFEEK

QAESMPEIETEQEYKEIFITPHQIKHIKDFKDYKYSHRVDKKPNRELIN

DTLYSTRKDDKGNTLIVNNLNGLYDKDNDKLKKLINKSPEKLLMYHHDP

QTYQKLKLIMEQYGDEKNPLYKYYEETGNYLTKYSKKDNGPVIKKIKYY

GNKLNAHLDITDDYPNSRNKVVKLSLKPYRFDVYLDNGVYKFVTVKNLD

VIKKENYYEVNSKCYEEAKKLKKISNQAEFIASFYNNDLIKINGELYRV

IGVNNDLLNRIEVNMIDITYREYLENMNDKRPPRIIKTIASKTQSIKKY

STDILGNLYEVKSKKHPQIIKKG
```

Residue N579 of SEQ ID NO: 70, which is underlined and in bold, may be mutated (e.g., to a A579) to yield a SaCas9 nickase.

Nucleobase Modification Moiety/Nucleic Acid Effector Domain/Nucleic Acid Editing Domain In various embodiments, the improved base editors provided herein comprise one or more nucleic acid effector domains. In various embodiments, the nucleic acid effector domain may be any protein, enzyme, or polypeptide (or functional fragment thereof) which is capable of modifying a DNA or RNA molecule. Nucleobase modification moieties can be naturally occurring, or can be recombinant. For example, a nucleobase modification moiety can include one or more DNA repair enzymes, for example, and an enzyme or protein involved in base excision repair (BER), nucleotide excision repair (NER), homology-dependent recombinational repair (HR), non-homologous end-joining repair (NHEJ), microhomology end-joining repair (MMEJ), mismatch repair (MMR), direct reversal repair, or other known DNA repair pathway. A nucleobase modification moiety can have one or more types of enzymatic activities, including, but not limited to endonuclease activity, polymerase activity, ligase activity, replication activity, proofreading activity. Nucleobase modification moieties can also include DNA or RNA-modifying enzymes and/or mutagenic enzymes, such as, DNA methylases and deaminating enzymes (i.e., deaminases, including cytidine deaminases and adenosine deaminases, all defined above), which deaminate nucleobases leading in some cases to mutagenic corrections by way of normal cellular DNA repair and replication processes. The "nucleic acid effector domain" (e.g., a DNA effector domain or an RNA effector domain) as used herein may also refer to a protein or enzyme capable of making one or more modifications (e.g., deamination of a cytidine residue) to a nucleic acid (e.g., DNA or RNA). Exemplary nucleic acid editing domains include, but are not limited to a deaminase, a nuclease, a nickase, a recombinase, a methyltransferase, a methylase, an acetylase, an acetyltransferase, a transcriptional activator, or a transcriptional repressor domain. In some embodiments the nucleic acid editing domain is a deaminase (e.g., a cytidine deaminase, such as an APOBEC or an AID deaminase).

In some embodiments, the nucleic acid editing domain comprises a deaminase. In some embodiments, the nucleic acid editing domain comprises a deaminase. In some embodiments, the deaminase is a cytidine deaminase. In other embodiments, the deaminase is an adenosine deaminase. In some embodiments, the deaminase is an apolipoprotein B mRNA-editing complex (APOBEC) family deaminase. In some embodiments, the deaminase is an APOBEC1 deaminase, an APOBEC2 deaminase, an APOBEC3A deaminase, an APOBEC3B deaminase, an APOBEC3C deaminase, an APOBEC3D deaminase, an APOBEC3F deaminase, an APOBEC3G deaminase, an APOBEC3H deaminase, or an APOBEC4 deaminase. In some embodiments, the deaminase is an activation-induced deaminase (AID). In some embodiments, the deaminase is a Lamprey CDA1 (pmCDA1) deaminase. In some embodiments, the deaminase is from a human, chimpanzee, gorilla, monkey, cow, dog, rat, or mouse. In some embodiments, the deaminase is from a human. In some embodiments the deaminase is from a rat. In some embodiments, the deaminase is a rat APOBEC1 deaminase comprising the amino acid sequence set forth in (SEQ ID NO: 98). In some embodiments, the deaminase is a human APOBEC1 deaminase comprising the amino acid sequence set forth in (SEQ ID NO: 96). In some embodiments, the deaminase is pmCDA1 (SEQ ID NO: 103). In some embodiments, the deaminase is human APOBEC3G (SEQ ID NO: 82). In some embodiments, the deaminase is a human APOBEC3G variant of any one of (SEQ ID NOs: 104-106). In some embodiments, the deaminase is at least 80%, at least 85%, at least 90%, at least 92%, at least 95%, at least 96%, at least 97%, at least 98%, at least 99%, or at least 99.5% identical to any one of the amino acid sequences set forth in SEQ ID NOs: 4-9 or 72-106.

Some exemplary suitable nucleic-acid editing domains, e.g., deaminases and deaminase domains, that can be fused to Cas9 domains according to aspects of this disclosure are provided below. It should be understood that, in some embodiments, the active domain of the respective sequence can be used, e.g., the domain without a localizing signal (nuclear localization sequence, without nuclear export signal, cytoplasmic localizing signal).

Human AID:

(SEQ ID NO: 72)
<u>MDSLLMNRRKFLYQFKNVRWAKGRRETYLC</u>YVVKRRDSATSFSLDFGYL

RNKNGCHVELLFLRYISDWDLDPGRCYRVTWFTSWSPCYDCARHVADFL

RGNPNLSLRIFTARLYFCEDRKAEPEGLRRLHRAGVQIAIMTFKDYFYC

WNTFVENHERTFKAWEGLHENSVRLSRQLRRILL<u><u>PLYEVDDLRDAFRTL</u></u>

<u><u>GL</u></u>

(underline: nuclear localization sequence; double underline: nuclear export signal)

Mouse AID:

(SEQ ID NO: 73)
<u>MDSLLMKQKKFLYHFKNVRWAKGRHETYLC</u>YVVKRRDSATSCSLDFGHL

RNKSGCHVELLFLRYISDWDLDPGRCYRVTWFTSWSPCYDCARHVAEFL

RWNPNLSLRIFTARLYFCEDRKAEPEGLRRLHRAGVQIGIMTFKDYFYC

WNTFVENRERTFKAWEGLHENSVRLTRQLRRILL<u><u>PLYEVDDLRDAFRML</u></u>

<u><u>GF</u></u>

(underline: nuclear localization sequence; double underline: nuclear export signal)

Dog AID:

(SEQ ID NO: 74)
<u>MDSLLMKQRKFLYHFKNVRWAKGRHETYLC</u>YVVKRRDSATSFSLDFGHL

RNKSGCHVELLFLRYISDWDLDPGRCYRVTWFTSWSPCYDCARHVADFL

RGYPNLSLRIFAARLYFCEDRKAEPEGLRRLHRAGVQIAIMTFKDYFYC

WNTFVENREKTFKAWEGLHENSVRLSRQLRRILL<u><u>PLYEVDDLRDAFRTL</u></u>

<u><u>GL</u></u>

(underline: nuclear localization sequence; double underline: nuclear export signal)

Bovine AID:

(SEQ ID NO: 75)
<u>MDSLLKKQRQFLYQFKNVRWAKGRHETYLC</u>YVVKRRDSPTSFSLDFGHL

RNKAGCHVELLFLRYISDWDLDPGRCYRVTWFTSWSPCYDCARHVADFL

RGYPNLSLRIFTARLYFCDKERKAEPEGLRRLHRAGVQIAIMTFKDYFY

CWNTFVENHERTFKAWEGLHENSVRLSRQLRRILL<u><u>PLYEVDDLRDAFRT</u></u>

<u><u>LGL</u></u>

(underline: nuclear localization sequence; double underline: nuclear export signal)

Rat:AID:

(SEQ ID NO: 76)
<u>MAVGSKPKAALVGPHWERERIWCFLCSTGLGTQQTGQTSRWLRPAATQD</u>

<u>PVSPPRSLLMKQRKFLYHFKNVRWAKGRHETYLC</u>YVVKRRDSATSFSLD

FGYLRNKSGCHVELLFLRYISDWDLDPGRCYRVTWFTSWSPCYDCARHV

ADFLRGNPNLSLRIFTARLTGWGALPAGLMSPARPSDYFYCWNTFV<u>ENH</u>

<u>ERTFKAWEGLHENSVRLSRRLRRILLPLYEVDDLRDAFRTLGL</u>

(underline: nuclear localization sequence; double underline: nuclear export signal)
Mouse APOBEC-3:

(SEQ ID NO: 77)
MGPFCLGCSHRKCYSPIRNLISQETFKFHFKNLGYAKGRKDTFLCYEVT

RKDCDSPVSLHHGVFKNKDNI*HAEICFLYWFHDKVLKVLSPREEFKITW*

*YMSWSPCFEC*AEQIVRFLATHHNLSLDIFSSRLYNVQDPETQQNLCRLV

QEGAQVAAMDLYEFKKCWKKFVDNGGRRFRPWKRLLTNFRYQDSKLQEI

LRPCYIPVPSSSSSTLSNICLTKGLPETRFCVEGRRMDPLSEEEFYSQF

YNQRVKHLCYYHRMKPYLCYQLEQFNGQAPLKGCLLSEKGKQ*HAEILFL*

*DKIRSMELSQVTITCYLTWSPCPNCAWQLAAFKRDRPDLILHIYTSRLY*

FHWKRPFQKGLCSLWQSGILVDVMDLPQFTDCWTNFVNPKRPFWPWKGL

EIISRRTQRRLRRIKESWGLQDLVNDFGNLQLGPPMS (italic: nucleic acid editing domain)
Rat APOBEC-3:

(SEQ ID NO: 78)
MGPFCLGCSHRKCYSPIRNLISQETFKFHFKNLRYAIDRKDTFLCYEVT

RKDCDSPVSLHHGVFKNKDNI*HAEICFLYWFHDKVLKVLSPREEFKITW*

*YMSWSPCFEC*AEQVLRFLATHHNLSLDIFSSRLYNIRDPENQQNLCRLV

QEGAQVAAMDLYEFKKCWKKFVDNGGRRFRPWKKLLTNFRYQDSKLQEI

LRPCYIPVPSSSSSTLSNICLTKGLPETRFCVERRRVHLLSEEEFYSQF

YNQRVKHLCYYHGVKPYLCYQLEQFNGQAPLKGCLLSEKGKQ*HAEILFL*

*DKIRSMELSQVIITCYLTWSPCPNCAWQLAAFKRDRPDLILHIYTSRLY*

FHWKRPFQKGLCSLWQSGILVDVMDLPQFTDCWTNFVNPKRPFWPWKGL

EIISRRTQRRLHRIKESWGLQDLVNDFGNLQLGPPMS (italic: nucleic acid editing domain)
Rhesus Macaque APOBEC-3G:

(SEQ ID NO: 79)
<u>MVEPMDPRTFVSNFNNRPILSGLNTVWLCCEVKTKDPSGPPL</u><u>DAKIFQG</u>

<u>KVYSKAKY</u>*HPEMRFLRWFHKWRQLHHDQEYKVTWYVSWSPCTRC*ANSVA

TFLAKDPKVTLTIFVARLYYFWKPDYQQALRILCQKRGGPHATMKIMNY

NEFQDCWNKFVDGRGKPFKPRNNLPKHYTLLQATLGELLRHLMDPGTFT

SNFNNKPWVSGQHETYLCYKVERLHNDTWVPLNQHRGFLRNQAPNIHGF

PKGR*HAELCFLDLIPFWKLDGQQYRVTCFTSWSPCFSC*AQEMAKFISNN

EHVSLCIFAARIYDDQGRYQEGLRALHRDGAKIAMMNYSEFEYCWDTFV

DRQGRPFQPWDGLDEHSQALSGRLRAI (italic: nucleic acid editing domain; underline: cytoplasmic localization signal)
Chimpanzee APOBEC-3G:

(SEQ ID NO: 80)
<u>MKPHFRNPVERMYQDTFSDNFYNRPILSHRNTVWLCYEVKTKGPSRPPL</u>

<u>DAKIFRGQVYSKLKY</u>*HPEMRFFHWFSKWRKLHRDQEYEVTWYISWSPCT*

*KC*TRDVATFLAEDPKVTLTIFVARLYYFWDPDYQEALRSLCQKRDGPRA

TMKIMNYDEFQHCWSKFVYSQRELFEPWNNLPKYYILLHIMLGEILRHS

MDPPTFTSNFNNELWVRGRHETYLCYEVERLHNDTWVLLNQRRGFLCNQ

APHKHGFLEGR*HAELCFLDVIPFWKLDLHQDYRVTCFTSWSPCFSC*AQE

MAKFISNNKHVSLCIFAARIYDDQGRCQEGLRTLAKAGAKISIMTYSEF

KHCWDTFVDHQGCPFQPWDGLEEHSQALSGRLRAILQNQGN (italic: nucleic acid editing domain; underline: cytoplasmic localization signal)
Green Monkey APOBEC-3G:

(SEQ ID NO: 81)
<u>MNPQIRNMVEQMEPDIFVYYFNNRPILSGRNTVWLCYEVKTKDPSGPPL</u>

<u>DANIFQGKLY</u><u>PEAKD</u>*HPEMKFLHWFRKWRQLHRDQEYEVTWYVSWSPCT*

*RC*ANSVATFLAEDPKVTLTIFVARLYYFWKPDYQQALRILCQERGGPHA

TMKIMNYNEFQHCWNEFVDGQGKPFKPRKNLPKHYTLLHATLGELLRHV

MDPGTFTSNFNNKPWVSGQRETYLCYKVERSHNDTWVLLNQHRGFLRNQ

APDRHGFPKGR*HAELCFLDLIPFWKLDDQQYRVTCFTSWSPCFSC*AQKM

AKFISNNKHVSLCIFAARIYDDQGRCQEGLRTLHRDGAKIAVMNYSEFE

YCWDTFVDRQGRPFQPWDGLDEHSQALSGRLRAI (italic: nucleic acid editing domain; underline: cytoplasmic localization signal)
Human APOBEC-3G:

(SEQ ID NO: 82)
<u>MKPHFRNTVERMYRDTFSYNFYNRPILSRRNTVWLCYEVKTKGPSRPPL</u>

<u>DAKIFRGQVYSELKY</u>*HPEMRFFHWFSKWRKLHRDQEYEVTWYISWSPCT*

*KC*TRDMATFLAEDPKVTLTIFVARLYYFWDPDYQEALRSLCQKRDGPRA

TMKIMNYDEFQHCWSKFVYSQRELFEPWNNLPKYYILLHIMLGEILRHS

MDPPTFTFNFNNEPWVRGRHETYLCYEVERMHNDTWVLLNQRRGFLCNQ

APHKHGFLEGR*HAELCFLDVIPFWKLDLDQDYRVTCFTSWSPCFSC*AQE

MAKFISKNKHVSLCIFTARIYDDQGRCQEGLRTLAEAGAKISIMTYSEF

KHCWDTFVDHQGCPFQPWDGLDEHSQDLSGRLRAILQNQEN (italic: nucleic acid editing domain; underline: cytoplasmic localization signal)
Human APOBEC-3F:

(SEQ ID NO: 83)
MKPHFRNTVERMYRDTFSYNFYNRPILSRRNTVWLCYEVKTKGPSRPRL

DAKIFRGQVYSQPEH*HAEMCFLSWFCGNQLPAYKCFQITWFVSWTPCPD

CVAKLAEFLAEHPNVTLTISAARLYYYWERDYRRALCRLSQAGARVKIM

DDEEFAYCWENFVYSEGQPFMPWYKFDDNYAFLHRTLKEILRNPMEAMY

PHIFYFHFKNLRKAYGRNESWLCFTMEVVKHHSPVSWKRGVFRNQVDPE

THCHAERCFLSWFCDDILSPNTNYEVTWYTSWSPCPEC*AGEVAEFLARH

SNVNLTIFTARLYYFWDTDYQEGLRSLSQEGASVEIMGYKDFKYCWENF

VYNDDEPFKPWKGLKYNFLFLDSKLQEILE (italic: nucleic acid editing domain)
Human APOBEC-3B:

(SEQ ID NO: 84)
MNPQIRNPMERMYRDTFYDNFENEPILYGRSYTWLCYEVKIKRGRSNLL

WDTGVFRGQVYFKPQYH*AEMCFLSWFCGNQLPAYKCFQITWFVSWTPCP

DC*VAKLAEFLSEHPNVTLTISAARLYYYWERDYRRALCRLSQAGARVTI

MDYEEFAYCWENFVYNEGQQFMPWYKFDENYAFLHRTLKEILRYLMDPD

TFTFNFNNDPLVLRRRQTYLCYEVERLDNGTWVLMDQHMGFLCNEAKNL

LCGFY*GRHAELRFLDLVPSLQLDPAQIYRVTWFISWSPCFSWGC*AGEVR

AFLQENTHVRLRIFAARIYDYDPLYKEALQMLRDAGAQVSIMTYDEFEY

CWDTFVYRQGCPFQPWDGLEEHSQALSGRLRAILQNQGN (italic: nucleic acid editing domain)
Rat APOBEC-3B:

(SEQ ID NO: 85)
MQPQGLGPNAGMGPVCLGCSHRRPYSPIRNPLKKLYQQTFYFHFKNVRY

AWGRKNNFLCYEVNGMDCALPVPLRQGVFRKQGHIHAELCFIYWFHDKV

LRVLSPMEEFKVTWYMSWSPCSKCAEQVARFLAAHRNLSLAIFSSRLYY

YLRNPNYQQKLCRLIQEGVHVAAMDLPEFKKCWNKFVDNDGQPFRPWMR

LRINFSFYDCKLQEIFSRMNLLREDVFYLQFNNSHRVKPVQNRYYRRKS

YLCYQLERANGQEPLKGYLLYKKGEQHVEILFLEKMRSMELSQVRITCY

LTWSPCPNCARQLAAFKKDHPDLILRIYTSRLYFYWRKKFQKGLCTLWR

SGIHVDVMDLPQFADCWTNFVNPQRPFRPWNELEKNSWRIQRRLRRIKE

SWGL

Bovine APOBEC-3B:

(SEQ ID NO: 86)
DGWEVAFRSGTVLKAGVLGVSMTEGWAGSGHPGQGACVWTPGTRNTMNL

LREVLFKQQFGNQPRVPAPYYRRKTYLCYQLKQRNDLTLDRGCFRNKKQ

RHAEIRFIDKINSLDLNPSQSYKIICYITWSPCPNCANELVNFITRNNH

LKLEIFASRLYFHWIKSFKMGLQDLQNAGISVAVMTHTEFEDCWEQFVD

NQSRPFQPWDKLEQYSASIRRRLQRILTAPI

Chimpanzee APOBEC-3B:

(SEQ ID NO: 87)
MNPQIRNPMEWMYQRTFYYNFENEPILYGRSYTWLCYEVKIRRGHSNLL

WDTGVFRGQMYSQPEHHAEMCFLSWFCGNQLSAYKCFQITWFVSWTPCP

DCVAKLAKFLAEHPNVTLTISAARLYYYWERDYRRALCRLSQAGARVKI

MDDEEFAYCWENFVYNEGQPFMPWYKFDDNYAFLHRTLKEIIRHLMDPD

TFTFNFNNDPLVLRRHQTYLCYEVERLDNGTWVLMDQHMGFLCNEAKNL

LCGFYGRHAELRFLDLVPSLQLDPAQIYRVTWFISWSPCFSWGCAGQVR

AFLQENTHVRLRIFAARIYDYDPLYKEALQMLRDAGAQVSIMTYDEFEY

CWDTFVYRQGCPFQPWDGLEEHSQALSGRLRAILQVRASSLCMVPHRPP

PPPQSPGPCLPLCSEPPLGSLLPTGRPAPSLPFLLTASFSFPPPASLPP

LPSLSLSPGHLPVPSFHSLTSCSIQPPCSSRIRETEGWASVSKEGRDLG

Human APOBEC-3C:

(SEQ ID NO: 88)
MNPQIRNPMKAMYPGTFYFQFKNLWEANDRNETWLCFTVEGIKRRSVVS

WKTGVFRNQVDSETHC*HAERCFLSWFCDDILSPNTKYQVTWYTSWSPCP

DC*AGEVAEFLARHSNVNLTIFTARLYYFQYPCYQEGLRSLSQEGVAVEI

MDYEDFKYCWENFVYNDNEPFKPWKGLKTNFRLLKRRLRESLQ (italic: nucleic acid editing domain)
Gorilla APOBEC3C:

(SEQ ID NO: 89)
MNPQIRNPMKAMYPGTFYFQFKNLWEANDRNETWLCFTVEGIKRRSVVS

WKTGVFRNQVDSETHC*HAERCFLSWFCDDILSPNTNYQVTWYTSWSPCP

EC*AGEVAEFLARHSNVNLTIFTARLYYFQDTDYQEGLRSLSQEGVAVKI

MDYKDFKYCWENFVYNDDEPFKPWKGLKYNFRFLKRRLQEILE (italic: nucleic acid editing domain)
Human APOBEC-3A:

(SEQ ID NO: 90)
MEASPASGPRHLMDPHIFTSNFNNGIGRHKTYLCYEVERLDNGTSVKMD

QHRGFLHNQAKNLLCGFY*GRHAELRFLDLVPSLQLDPAQIYRVTWFISW

*SPCFSWGC*AGEVRAFLQENTHVRLRIFAARIYDYDPLYKEALQMLRDAG

AQVSIMTYDEFKHCWDTFVDHQGCPFQPWDGLDEHSQALSGRLRAILQN

QGN (italic: nucleic acid editing domain)
Rhesus Macaque APOBEC-3A:

(SEQ ID NO: 91)
MDGSPASRPRHLMDPNTFTFNFNNDLSVRGRHQTYLCYEVERLDNGTWV

PMDERRGFLCNKAKNVPCGDYGC*HVELRFLCEVPSWQLDPAQTYRVTWF*

*ISWSPCF*RRGCAGQVRVFLQENKHVRLRIFAARIYDYDPLYQEALRTLR

DAGAQVSIMTYEEFKHCWDTFVDRQGRPFQPWDGLDEHSQALSGRLRAI

LQNQGN (italic: nucleic acid editing domain)
Bovine APOBEC-3A:

(SEQ ID NO: 92)
MDEYTFTENFNNQGWPSKTYLCYEMERLDGDATIPLDEYKGFVRNKGLD

QPEKPC*HAELYFLGKIHSWNLDRNQHYRLTCFISWSPC*YDCAQKLTTFL

KENHHISLHILASRIYTHNRFGCHQSGLCELQAAGARITIMTFEDFKHC

WETFVDHKGKPFQPWEGLNVKSQALCTELQAILKTQQN (italic: nucleic acid editing domain)
Human APOBEC-3H:

(SEQ ID NO: 93)
MALLTAETFRLQFNNKRRLRRPYYPRKALLCYQLTPQNGSTPTRGYFEN

KKKC*HAEICFINEIKSMGLDETQCYQVTCYLTWSPCSSC*AWELVDFIKA

HDHLNLGIFASRLYYHWCKPQQKGLRLLCGSQVPVEVMGFPKFADCWEN

FVDHEKPLSFNPYKMLEELDKNSRAIKRRLERIKIPGVRAQGRYMDILC

DAEV (italic: nucleic acid editing domain)
Rhesus macaque APOBEC-3H:

(SEQ ID NO: 94)
MALLTAKTFSLQFNNKRRVNKPYYPRKALLCYQLTPQNGSTPTRGHLKN

KKKDHAEIRFINKIKSMGLDETQCYQVTCYLTWSPCPSCAGELVDFIKA

HRHLNLRIFASRLYYHWRPNYQEGLLLLCGSQVPVEVMGLPEFTDCWEN

FVDHKEPPSFNPSEKLEELDKNSQAIKRRLERIKSRSVDVLENGLRSLQ

LGPVTPSSSIRNSR

Human APOBEC-3D:

(SEQ ID NO: 95)
MNPQIRNPMERMYRDTFYDNFENEPILYGRSYTWLCYEVKIKRGRSNLL

WDTGVFRGPVLPKRQSNHRQEVYFRFEN*HAEMCFLSWFCGNRLPANRRF*

*QITWFVSWNPCLPC*VVKVTKFLAEHPNVTLTISAARLYYYRDRDWRWVL

LRLHKAGARVKIMDYEDFAYCWENFVCNEGQPFMPWYKFDDNYASLHRT

LKEILRNPMEAMYPHIFYFHFKNLLKACGRNESWLCFTMEVTKHHSAVF

RKRGVFRNQVDPETHC*HAERCFLSWFCDDILSPNTNYEVTWYTSWSPCP*

*EC*AGEVAEFLARHSNVNLTIFTARLCYFWDTDYQEGLCSLSQEGASVKI

MGYKDFVSCWKNFVYSDDEPFKPWKGLQTNFRLLKRRLREILQ (italic: nucleic acid editing domain)
Human APOBEC-1:

(SEQ ID NO: 96)
MTSEKGPSTGDPTLRRRIEPWEFDVFYDPRELRKEACLLYEIKWGMSRK

IWRSSGKNTTNHVEVNFIKKFTSERDFHPSMSCSITWFLSWSPCWECSQ

AIREFLSRHPGVTLVIYVARLFWHMDQQNRQGLRDLVNSGVTIQIMRAS

EYYHCWRNFVNYPPGDEAHWPQYPPLWMMLYALELHCIILSLPPCLKIS

RRWQNHLTFFRLHLQNCHYQTIPPHILLATGLIHPSVAWR

Mouse APOBEC-1:

(SEQ ID NO: 97)
MSSETGPVAVDPTLRRRIEPHEFEVFFDPRELRKETCLLYEINWGGRHS

VWRHTSQNTSNHVEVNFLEKFTTERYFRPNTRCSITWFLSWSPCGECSR

AITEFLSRHPYVTLFIYIARLYHHTDQRNRQGLRDLISSGVTIQIMTEQ

EYCYCWRNFVNYPPSNEAYWPRYPHLWVKLYVLELYCIILGLPPCLKIL

RRKQPQLTFFTITLQTCHYQRIPPHLLWATGLK

Rat APOBEC-1:

(SEQ ID NO: 98)
MSSETGPVAVDPTLRRRIEPHEFEVFFDPRELRKETCLLYEINWGGRHS

IWRHTSQNTNKHVEVNFIEKFTTERYFCPNTRCSITWFLSWSPCGECSR

AITEFLSRYPHVTLFIYIARLYHHADPRNRQGLRDLISSGVTIQIMTEQ

ESGYCWRNFVNYSPSNEAHWPRYPHLWVRLYVLELYCIILGLPPCLNIL

RRKQPQLTFFTIALQSCHYQRLPPHILWATGLK

Human APOBEC-2:

(SEQ ID NO: 99)
MAQKEEAAVATEAASQNGEDLENLDDPEKLKELIELPPFEIVTGERLPA

NFFKFQFRNVEYSSGRNKTFLCYVVEAQGKGGQVQASRGYLEDEHAAAH

AEEAFFNTILPAFDPALRYNVTWYVSSSPCAACADRIIKTLSKTKNLRL

LILVGRLFMWEEPEIQAALKKLKEAGCKLRIMKPQDFEYVWQNFVEQEE

GESKAFQPWEDIQENFLYYEEKLADILK

Mouse APOBEC-2:

(SEQ ID NO: 100)
MAQKEEAAEAAAPASQNGDDLENLEDPEKLKELIDLPPFEIVTGVRLPV

NFFKFQFRNVEYSSGRNKTFLCYVVEVQSKGGQAQATQGYLEDEHAGAH

AEEAFFNTILPAFDPALKYNVTWYVSSSPCAACADRILKTLSKTKNLRL

LILVSRLFMWEEPEVQAALKKLKEAGCKLRIMKPQDFEYIWQNFVEQEE

GESKAFEPWEDIQENFLYYEEKLADILK

Rat APOBEC-2:

(SEQ ID NO: 101)
MAQKEEAAEAAAPASQNGDDLENLEDPEKLKELIDLPPFEIVTGVRLPV

NFFKFQFRNVEYSSGRNKTFLCYVVEAQSKGGQVQATQGYLEDEHAGAH

AEEAFFNTILPAFDPALKYNVTWYVSSSPCAACADRILKTLSKTKNLRL

LILVSRLFMWEEPEVQAALKKLKEAGCKLRIMKPQDFEYLWQNFVEQEE

GESKAFEPWEDIQENFLYYEEKLADILK

Bovine APOBEC-2:

(SEQ ID NO: 102)
MAQKEEAAAAAEPASQNGEEVENLEDPEKLKELIELPPFEIVTGERLPA

HYFKFQFRNVEYSSGRNKTFLCYVVEAQSKGGQVQASRGYLEDEHATNH

AEEAFFNSIMPTFDPALRYMVTWYVSSSPCAACADRIVKTLNKTKNLRL

LILVGRLFMWEEPEIQAALRKLKEAGCRLRIMKPQDFEYIWQNFVEQEE

GESKAFEPWEDIQENFLYYEEKLADILK

*Petromyzon marinus* CDA1 (pmCDA1)

(SEQ ID NO: 103)
MTDAEYVRIHEKLDIYTFKKQFFNNKKSVSHRCYVLFELKRRGERRACF

WGYAVNKPQSGTERGIHAEIFSIRKVEEYLRDNPGQFTINWYSSWSPCA

DCAEKILEWYNQELRGNGHTLKIWACKLYYEKNARNQIGLWNLRDNGVG

LNVMVSEHYQCCRKIFIQSSHNQLNENRWLEKTLKRAEKRRSELSIMIQ

VKILHTTKSPAV

Human APOBEC3G D316R_D317R (SEQ ID NO: 104)
MKPHFRNTVERMYRDTFSYNFYNRPILSRRNTVWLCYEVKTKGPSRPPL

DAKIFRGQVYSELKYHPEMRFFHWFSKWRKLHRDQEYEVTWYISWSPCT

KCTRDMATFLAEDPKVTLTIFVARLYYFWDPDYQEALRSLCQKRDGPRA

TMKIMNYDEFQHCWSKFVYSQRELFEPWNNLPKYYILLHIMLGEILRHS

MDPPTFTFNFNNEPWVRGRHETYLCYEVERMHNDTWVLLNQRRGFLCNQ

APHKHGFLEGRHAELCFLDVIPFWKLDLDQDYRVTCFTSWSPCFSCAQE

MAKFISKNKHVSLCIFTARIYRRQGRCQEGLRTLAEAGAKISIMTYSEF

KHCWDTFVDHQGCPFQPWDGLDEHSQDLSGRLRAILQNQEN

Human APOBEC3G chain A (SEQ ID NO: 105)
MDPPTFTFNFNNEPWVRGRHETYLCYEVERMHNDTWVLLNQRRGFLCNQ

APHKHGFLEGRHAELCFLDVIPFWKLDLDQDYRVTCFTSWSPCFSCAQE

MAKFISKNKHVSLCIFTARIYDDQGRCQEGLRTLAEAGAKISIMTYSEF

KHCWDTFVDHQGCPFQPWDGLDEHSQDLSGRLRAILQ

Human APOBEC3G chain A D120R_D121R (SEQ ID NO: 106)
MDPPTFTFNFNNEPWVRGRHETYLCYEVERMHNDTWVLLNQRRGFLCNQ

APHKHGFLEGRHAELCFLDVIPFWKLDLDQDYRVTCFTSWSPCFSCAQE

MAKFISKNKHVSLCIFTARIYRRQGRCQEGLRTLAEAGAKISIMTYSEF

KHCWDTFVDHQGCPFQPWDGLDEHSQDLSGRLRAILQ

Cytidine Deaminases

Some aspects of the disclosure provide cytidine deaminases.

In some embodiments, second protein comprises a nucleic acid editing domain. In some embodiments, the nucleic acid editing domain can catalyze a C to U base change. In some embodiments, the nucleic acid editing domain is a deaminase domain. In some embodiments, the deaminase is a cytidine deaminase or a cytidine deaminase. In some embodiments, the deaminase is an apolipoprotein B mRNA-editing complex (APOBEC) family deaminase. In some embodiments, the deaminase is an APOBEC1 deaminase. In some embodiments, the deaminase is an APOBEC2 deaminase. In some embodiments, the deaminase is an APOBEC3 deaminase. In some embodiments, the deaminase is an APOBEC3A deaminase. In some embodiments, the deaminase is an APOBEC3B deaminase. In some embodiments, the deaminase is an APOBEC3C deaminase. In some embodiments, the deaminase is an APOBEC3D deaminase. In some embodiments, the deaminase is an APOBEC3E deaminase. In some embodiments, the deaminase is an APOBEC3F deaminase. In some embodiments, the deaminase is an APOBEC3G deaminase. In some embodiments, the deaminase is an APOBEC3H deaminase. In some embodiments, the deaminase is an APOBEC4 deaminase. In some embodiments, the deaminase is an activation-induced deaminase (AID). In some embodiments, the deaminase is a vertebrate deaminase. In some embodiments, the deaminase is an invertebrate deaminase. In some embodiments, the deaminase is a human, chimpanzee, gorilla, monkey, cow, dog, rat, or mouse deaminase. In some embodiments, the deaminase is a human deaminase. In some embodiments, the deaminase is a rat deaminase, e.g., rAPOBEC1. In some embodiments, the deaminase is a *Petromyzon marinus* cytidine deaminase 1 (pmCDA1). In some embodiments, the deaminase is a human APOBEC3G (SEQ ID NO: 82). In some embodiments, the deaminase is a fragment of the human APOBEC3G (SEQ ID NO: 105). In some embodiments, the deaminase is a human APOBEC3G variant comprising a D316R_D317R mutation (SEQ ID NO: 104). In some embodiments, the deaminase is a frantment of the human APOBEC3G and comprising mutations corresponding to the D316R_D317R mutations in SEQ ID NO: 82 (SEQ ID NO: 106).

In some embodiments, the nucleic acid editing domain is at least 80%, at least 85%, at least 90%, at least 92%, at least 95%, at least 96%, at least 97%, at least 98%, at least 99%, or at least 99.5% identical to the deaminase domain of any one of SEQ ID NOs: 4-9, or 72-106. In some embodiments, the nucleic acid editing domain comprises the amino acid sequence of any one of SEQ ID NOs: 4-9, or 72-106.

Deaminase Domains that Modulate the Editing Window of Base Editors

Some aspects of the disclosure are based on the recognition that modulating the deaminase domain catalytic activity of any of the fusion proteins provided herein, for example by making point mutations in the deaminase domain, affect the processivity of the fusion proteins (e.g., base editors). For example, mutations that reduce, but do not eliminate, the catalytic activity of a deaminase domain within a base editing fusion protein can make it less likely that the deaminase domain will catalyze the deamination of a residue adjacent to a target residue, thereby narrowing the deamination window. The ability to narrow the deamination window may prevent unwanted deamination of residues adjacent of specific target residues, which may decrease or prevent off-target effects.

In some embodiments, any of the fusion proteins provided herein comprise a deaminase domain (e.g., a cytidine deaminase domain) that has reduced catalytic deaminase activity. In some embodiments, any of the fusion proteins provided herein comprise a deaminase domain (e.g., a cytidine deaminase domain) that has a reduced catalytic deaminase activity as compared to an appropriate control. For example, the appropriate control may be the deaminase activity of the deaminase prior to introducing one or more mutations into the deaminase. In other embodiments, the appropriate control may be a wild-type deaminase. In some embodiments, the appropriate control is a wild-type apolipoprotein B mRNA-editing complex (APOBEC) family deaminase. In some embodiments, the appropriate control is an APOBEC1 deaminase, an APOBEC2 deaminase, an APOBEC3A deaminase, an APOBEC3B deaminase, an APOBEC3C deaminase, an APOBEC3D deaminase, an APOBEC3F deaminase, an APOBEC3G deaminase, or an APOBEC3H deaminase. In some embodiments, the appropriate control is an activation induced deaminase (AID). In some embodiments, the appropriate control is a cytidine deaminase 1 from *Petromyzon marinus* (pmCDA1). In some embodiments, the deaminase domain may be a deaminase domain that has at least 1%, at least 5%, at least 15%, at least 20%, at least 25%, at least 30%, at least 40%, at least 50%, at least 60%, at least 70%, at least 80%, at least 90%, or at least 95% less catalytic deaminase activity as compared to an appropriate control.

In some embodiments, any of the fusion proteins provided herein comprise an APOBEC deaminase comprising one or more mutations selected from the group consisting of H121X, H122X, R126X, R126X, R118X, W90X, W90X, and R132X of rAPOBEC1 (SEQ ID NO: 98), or one or more corresponding mutations in another APOBEC deaminase, wherein X is any amino acid. In some embodiments, any of the fusion proteins provided herein comprise an APOBEC deaminase comprising one or more mutations selected from the group consisting of H121R, H122R, R126A, R126E, R118A, W90A, W90Y, and R132E of rAPOBEC1 (SEQ ID NO: 98), or one or more corresponding mutations in another APOBEC deaminase.

In some embodiments, any of the fusion proteins provided herein comprise an APOBEC deaminase comprising one or more mutations selected from the group consisting of D316X, D317X, R320X, R320X, R313X, W285X, W285X, R326X of hAPOBEC3G (SEQ ID NO: 82), or one or more corresponding mutations in another APOBEC deaminase, wherein X is any amino acid. In some embodiments, any of the fusion proteins provided herein comprise an APOBEC deaminase comprising one or more mutations selected from the group consisting of D316R, D317R, R320A, R320E, R313A, W285A, W285Y, R326E of hAPOBEC3G (SEQ ID NO: 82), or one or more corresponding mutations in another APOBEC deaminase.

In some embodiments, any of the fusion proteins provided herein comprise an APOBEC deaminase comprising a H121R and a H122R mutation of rAPOBEC1 (SEQ ID NO: 98), or one or more corresponding mutations in another APOBEC deaminase. In some embodiments, any of the fusion proteins provided herein comprise an APOBEC deaminase comprising a R126A mutation of rAPOBEC1 (SEQ ID NO: 98), or one or more corresponding mutations in another APOBEC deaminase. In some embodiments, any of the fusion proteins provided herein comprise an APOBEC deaminase comprising a R126E mutation of rAPOBEC1 (SEQ ID NO: 98), or one or more corresponding mutations in another APOBEC deaminase. In some embodiments, any of the fusion proteins provided herein comprise an APOBEC deaminase comprising a R118A mutation of rAPOBEC1 (SEQ ID NO: 98), or one or more corresponding mutations in another APOBEC deaminase. In some embodiments, any of the fusion proteins provided herein comprise an APOBEC deaminase comprising a W90A mutation of rAPOBEC1 (SEQ ID NO: 98), or one or more corresponding mutations in another APOBEC deaminase. In some embodiments, any of the fusion proteins provided herein comprise an APOBEC deaminase comprising a W90Y mutation of rAPOBEC1 (SEQ ID NO: 98), or one or more corresponding mutations in another APOBEC deaminase. In some embodiments, any of the fusion proteins provided herein comprise an APOBEC deaminase comprising a R132E mutation of rAPOBEC1 (SEQ ID NO: 98), or one or more corresponding mutations in another APOBEC deaminase. In some embodiments, any of the fusion proteins provided herein comprise an APOBEC deaminase comprising a W90Y and a R126E mutation of rAPOBEC1 (SEQ ID NO: 98), or one or more corresponding mutations in another APOBEC deaminase. In some embodiments, any of the fusion proteins provided herein comprise an APOBEC deaminase comprising a R126E and a R132E mutation of rAPOBEC1 (SEQ ID NO: 98), or one or more corresponding mutations in another APOBEC deaminase. In some embodiments, any of the fusion proteins provided herein comprise an APOBEC deaminase comprising a W90Y and a R132E mutation of rAPOBEC1 (SEQ ID NO: 98), or one or more corresponding mutations in another APOBEC deaminase. In some embodiments, any of the fusion proteins provided herein comprise an APOBEC deaminase comprising a W90Y, R126E, and R132E mutation of rAPOBEC1 (SEQ ID NO: 98), or one or more corresponding mutations in another APOBEC deaminase.

In some embodiments, any of the fusion proteins provided herein comprise an APOBEC deaminase comprising a D316R and a D317R mutation of hAPOBEC3G (SEQ ID NO: 82), or one or more corresponding mutations in another APOBEC deaminase. In some embodiments, any of the fusion proteins provided herein comprise an APOBEC deaminase comprising a R320A mutation of hAPOBEC3G (SEQ ID NO: 82), or one or more corresponding mutations in another APOBEC deaminase. In some embodiments, any of the fusion proteins provided herein comprise an APOBEC deaminase comprising a R320E mutation of hAPOBEC3G (SEQ ID NO: 82), or one or more corresponding mutations in another APOBEC deaminase. In some embodiments, any of the fusion proteins provided herein comprise an APOBEC deaminase comprising a R313A mutation of hAPOBEC3G (SEQ ID NO: 82), or one or more corresponding mutations in another APOBEC deaminase. In some embodiments, any of the fusion proteins provided herein comprise an APOBEC deaminase comprising a W285A mutation of hAPOBEC3G (SEQ ID NO: 82), or one or more corresponding mutations in another APOBEC deaminase. In some embodiments, any of the fusion proteins provided herein comprise an APOBEC deaminase comprising a W285Y mutation of hAPOBEC3G (SEQ ID NO: 82), or one or more corresponding mutations in another APOBEC deaminase. In some embodiments, any of the fusion proteins provided herein comprise an APOBEC deaminase comprising a R326E mutation of hAPOBEC3G (SEQ ID NO: 82), or one or more corresponding mutations in another APOBEC deaminase. In some embodiments, any of the fusion proteins provided herein comprise an APOBEC deaminase comprising a W285Y and a R320E mutation of hAPOBEC3G (SEQ ID NO: 82), or one or more corresponding mutations in another APOBEC deaminase. In some embodiments, any of the fusion proteins provided herein comprise an APOBEC deaminase comprising a R320E and a R326E mutation of hAPOBEC3G (SEQ ID NO: 82), or one or more corresponding mutations in another APOBEC deaminase. In some embodiments, any of the fusion proteins provided herein comprise an APOBEC deaminase comprising a W285Y and a R326E mutation of hAPOBEC3G (SEQ ID NO: 82), or one or more corresponding mutations in another APOBEC deaminase. In some embodiments, any of the fusion proteins provided herein comprise an APOBEC deaminase comprising a W285Y, R320E, and R326E mutation of hAPOBEC3G (SEQ ID NO: 82), or one or more corresponding mutations in another APOBEC deaminase.

Some aspects of this disclosure provide fusion proteins comprising (i) a nuclease-inactive Cas9 domain; and (ii) a nucleic acid editing domain. In some embodiments, a nuclease-inactive Cas9 domain (dCas9), comprises an amino acid sequence that is at least 80%, at least 85%, at least 90%, at least 92%, at least 95%, at least 96%, at least 97%, at least 98%, at least 99%, or at least 99.5% identical to the amino acid sequence of a Cas9 as provided by any one of the Cas9 moieties provided herein, and comprises mutations that inactivate the nuclease activity of Cas9. Mutations that render the nuclease domains of Cas9 inactive are well-known in the art. For example, the DNA cleavage domain of Cas9 is known to include two subdomains, the HNH nuclease subdomain and the RuvC1 subdomain. The HNH subdomain cleaves the strand complementary to the gRNA, whereas the RuvC1 subdomain cleaves the non-complementary strand. Mutations within these subdomains can silence the nuclease activity of Cas9. For example, the mutations D10A and H840A completely inactivate the nuclease activity of *S. pyogenes* Cas9 (Jinek et al., *Science*. 337:816-821 (2012); Qi et al., *Cell*. 28; 152(5):1173-83 (2013)). In some embodiments, the dCas9 of this disclosure comprises a D10A mutation of the amino acid sequence provided in SEQ ID NO: 107, or a corresponding mutation in any of the amino acid sequences provided herein. In some embodiments, the dCas9 of this disclosure comprises a H840A mutation of the amino acid sequence provided in SEQ ID NO: 107, or a corresponding mutation in any of the amino acid sequences provided herein. In some embodiments, the dCas9 of this disclosure comprises both D10A and H840A mutations of the amino acid sequence provided in SEQ ID NO: 107, or a corresponding mutation in any of the amino acid sequences provided herein. In some embodiments, the Cas9 further comprises a histidine residue at position 840 of the amino acid sequence provided in SEQ ID NO: 107, or a corresponding mutation in any of the amino acid sequences provided herein. The presence of the catalytic residue H840 restores the activity of the Cas9 to cleave the non-edited strand containing a G opposite the targeted C. Restoration of H840 does not result in the cleavage of the target strand containing the C. In some embodiments, the dCas9 comprises an amino acid sequence of SEQ ID NO: 53. It is to be understood that other mutations that inactivate the nuclease domains of Cas9 may also be included in the dCas9 of this disclosure.

Wild type Cas9 corresponding to Cas9 from *Streptococcus pyogenes*

(SEQ ID NO: 107)
MDKKYSIGLDIGTNSVGWAVITDEYKVPSKKFKVLGNTDRHSIKKNLIG

ALLFDSGETAEATRLKRTARRRYTRRKNRICYLQEIFSNEMAKVDDSFF

HRLEESFLVEEDKKHERHPIFGNIVDEVAYHEKYPTIYHLRKKLVDSTD

KADLRLIYLALAHMIKFRGHFLIEGDLNPDNSDVDKLFIQLVQTYNQLF

EENPINASGVDAKAILSARLSKSRRLENLIAQLPGEKKNGLFGNLIALS

LGLTPNFKSNFDLAEDAKLQLSKDTYDDDLDNLLAQIGDQYADLFLAAK

NLSDAILLSDILRVNTEITKAPLSASMIKRYDEHHQDLTLLKALVRQQL

PEKYKEIFFDQSKNGYAGYIDGGASQEEFYKFIKPILEKMDGTEELLVK

LNREDLLRKQRTFDNGSIPHQIHLGELHAILRRQEDFYPFLKDNREKIE

KILTFRIPYYVGPLARGNSRFAWMTRKSEETITPWNFEEVVDKGASAQS

FIERMTNFDKNLPNEKVLPKHSLLYEYFTVYNELTKVKYVTEGMRKPAF

LSGEQKKAIVDLLFKTNRKVTVKQLKEDYFKKIECFDSVEISGVEDRFN

ASLGTYHDLLKIIKDKDFLDNEENEDILEDIVLTLTLFEDREMIEERLK

TYAHLFDDKVMKQLKRRRYTGWGRLSRKLINGIRDKQSGKTILDFLKSD

GFANRNFMQLIHDDSLTFKEDIQKAQVSGQGDSLHEHIANLAGSPAIKK

GILQTVKVVDELVKVMGRHKPENIVIEMARENQTTQKGQKNSRERMKRI

EEGIKELGSQILKEHPVENTQLQNEKLYLYYLQNGRDMYVDQELDINRL

SDYDVDHIVPQSFLKDDSIDNKVLTRSDKNRGKSDNVPSEEVVKKMKNY

WRQLLNAKLITQRKFDNLTKAERGGLSELDKAGFIKRQLVETRQITKHV

AQILDSRMNTKYDENDKLIREVKVITLKSKLVSDFRKDFQFYKVREINN

YHHAHDAYLNAVVGTALIKKYPKLESEFVYGDYKVYDVRKMIAKSEQEI

GKATAKYFFYSNIMNFFKTEITLANGEIRKRPLIETNGETGEIVWDKGR

DFATVRKVLSMPQVNIVKKTEVQTGGFSKESILPKRNSDKLIARKKDWD

PKKYGGFDSPTVAYSVLVVAKVEKGKSKKLKSVKELLGITIMERSSFEK

NPIDFLEAKGYKEVKKDLIIKLPKYSLFELENGRKRMLASAGELQKGNE

LALPSKYVNFLYLASHYEKLKGSPEDNEQKQLFVEQHKHYLDEIIEQIS

EFSKRVILADANLDKVLSAYNKHRDKPIREQAENIIHLFTLTNLGAPAA

FKYFDTTIDRKRYTSTKEVLDATLIHQSITGLYETRIDLSQLGGD

The Cas9 or dCas9 domains comprising the mutations disclosed herein, may be a full-length Cas9, or a fragment thereof. In some embodiments, proteins comprising Cas9, or fragments thereof, are referred to as "Cas9 variants." A Cas9 variant shares homology to Cas9, or a fragment thereof. For example a Cas9 variant is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% to wild type Cas9. In some embodiments, the Cas9 variant comprises a fragment of Cas9 (e.g., a gRNA binding domain or a DNA-cleavage domain), such that the fragment is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% identical to the corresponding fragment of wild type Cas9, e.g., a Cas9 comprising the amino acid sequence of SEQ ID NO: 107.

Any of the Cas9 fusion proteins of this disclosure may further comprise a nucleic acid editing domain (e.g., an enzyme that is capable of modifying nucleic acid, such as a deaminase). In some embodiments, the nucleic acid editing domain is a DNA-editing domain. In some embodiments, the nucleic acid editing domain has deaminase activity. In some embodiments, the nucleic acid editing domain comprises or consists of a deaminase or deaminase domain. In some embodiments, the deaminase is a cytidine deaminase. In some embodiments, the deaminase is an apolipoprotein B mRNA-editing complex (APOBEC) family deaminase. In some embodiments, the deaminase is an APOBEC1 family deaminase. In some embodiments, the deaminase is an activation-induced cytidine deaminase (AID). Some nucleic-acid editing domains as well as Cas9 fusion proteins including such domains are described in detail herein. Additional suitable nucleic acid editing domains will be apparent to the skilled artisan based on this disclosure and knowledge in the field.

Some aspects of the disclosure provide a fusion protein comprising a Cas9 domain fused to a nucleic acid editing domain, wherein the nucleic acid editing domain is fused to the N-terminus of the Cas9 domain. In some embodiments, the Cas9 domain and the nucleic acid editing-editing domain are fused via a linker. In some embodiments, the linker comprises a (GGGS)$_n$ (SEQ ID NO: 109), a (GGGGS)$_n$ (SEQ ID NO: 110), a (G)$_n$ (SEQ ID NO: 118), an (EAAAK)$_n$ (SEQ ID NO: 111), a (GGS)$_n$ (SEQ ID NO: 112), (SGGS)$_n$ (SEQ ID NO: 113), an SGSETPGTSESATPES (SEQ ID NO: 114) motif (see, e.g., Guilinger J P, Thompson D B, Liu D R. Fusion of catalytically inactive Cas9 to FokI nuclease improves the specificity of genome modification. *Nat. Biotechnol.* 2014; 32(6): 577-82; the entire contents are incorporated herein by reference), or an (XP)$_n$ motif (SEQ ID NO: 120), or a combination of any of these, wherein n is independently an integer between 1 and 30. In some embodiments, n is independently 1, 2, 3, 4, 5, 6, 7, 8, 9, 10, 11, 12, 13, 14, 15, 16, 17, 18, 19, 20, 21, 22, 23, 24, 25, 26, 27, 28, 29, or 30, or, 1f more than one linker or more than one linker motif is present, any combination thereof. In some embodiments, the linker comprises a (GGS)$_n$ motif (SEQ ID NO: 112), wherein n is 1, 2, 3, 4, 5, 6, 7, 8, 9, 10, 11, 12, 13, 14 or 15. In some embodiments, the linker comprises a (GGS)$_n$ motif (SEQ ID NO: 112), wherein n is 1, 3, or 7. In some embodiments, the linker comprises the amino acid sequence SGSETPGTSESATPES (SEQ ID NO: 114). Additional suitable linker motifs and linker configurations will be apparent to those of skill in the art. In some embodiments, suitable linker motifs and configurations include those described in Chen et al., Fusion protein linkers: property, design and functionality. *Adv Drug Deliv Rev.* 2013; 65(10):1357-69, the entire contents of which are incorporated herein by reference. Additional suitable linker sequences will be apparent to those of skill in the art based on the instant disclosure. In some embodiments, the general architecture of exemplary Cas9 fusion proteins provided herein comprises the structure:

[NH$_2$]-[nucleic acid editing domain]-[Cas9]-[COOH]
or

[NH$_2$]-[nucleic acid editing domain]-[linker]-[Cas9]-[COOH], wherein NH$_2$ is the N-terminus of the fusion protein, and COOH is the C-terminus of the fusion protein.

The fusion proteins of the present disclosure may comprise one or more additional features. For example, in some embodiments, the fusion protein comprises a nuclear localization sequence (NLS). In some embodiments, the NLS of the fusion protein is localized between the nucleic acid editing domain and the Cas9 domain. In some embodiments, the NLS of the fusion protein is localized C-terminal to the Cas9 domain.

In some embodiments, the nucleic acid editing domain is a deaminase. For example, in some embodiments, the general architecture of exemplary Cas9 fusion proteins with a deaminase domain comprises the structure:

[NH$_2$]-[NLS]-[deaminase]-[Cas9]-[COOH],

[NH$_2$]-[Cas9]-[deaminase]-[COOH],

[NH$_2$]-[deaminase]-[Cas9]-[COOH], or

[NH$_2$]-[deaminase]-[Cas9]-[NLS]-[COOH]

wherein NLS is a nuclear localization sequence, NH$_2$ is the N-terminus of the fusion protein, and COOH is the C-terminus of the fusion protein. Nuclear localization sequences are known in the art and would be apparent to the skilled artisan. For example, NLS sequences are described in Plank et al., PCT/EP2000/011690, the contents of which are incorporated herein by reference for their disclosure of exemplary nuclear localization sequences. In some embodiments, a NLS comprises the amino acid sequence PKKKRKV (SEQ ID NO: 115) or MDSLLMNRRKFLYQFKNVRWAKGRRETYLC (SEQ ID NO: 116). In some embodiments, a linker is inserted between the Cas9 and the deaminase. In some embodiments, the NLS is located C-terminal of the Cas9 domain. In some embodiments, the NLS is located N-terminal of the Cas9 domain. In some embodiments, the NLS is located between the deaminase and the Cas9 domain. In some embodiments, the NLS is located N-terminal of the deaminase domain. In some embodiments, the NLS is located C-terminal of the deaminase domain.

One exemplary suitable type of nucleic acid editing domain is a cytidine deaminase, for example, of the APOBEC family. The apolipoprotein B mRNA-editing complex (APOBEC) family of cytidine deaminase enzymes encompasses eleven proteins that serve to initiate mutagenesis in a controlled and beneficial manner.[29] One family member, activation-induced cytidine deaminase (AID), is responsible for the maturation of antibodies by converting cytosines in ssDNA to uracils in a transcription-dependent, strand-biased fashion.[30] The apolipoprotein B editing complex 3 (APOBEC3) enzyme provides protection to human cells against a certain HIV-1 strain via the deamination of cytosines in reverse-transcribed viral ssDNA. These proteins all require a $Zn^{2+}$-coordinating motif (His-X-Glu-X23-26-Pro-Cys-X2-4-Cys; SEQ ID NO: 117) and bound water molecule for catalytic activity. The Glu residue acts to activate the water molecule to a zinc hydroxide for nucleophilic attack in the deamination reaction. Each family member preferentially deaminates at its own particular "hotspot", ranging from WRC (W is A or T, R is A or G) for hAID, to TTC for hAPOBEC3F.[32] A recent crystal structure of the catalytic domain of APOBEC3G revealed a secondary structure comprised of a five-stranded β-sheet core flanked by six α-helices, which is believed to be conserved across the entire family.[33] The active center loops have been shown to be responsible for both ssDNA binding and in determining "hotspot" identity.[34] Overexpression of these enzymes has been linked to genomic instability and cancer, thus highlighting the importance of sequence-specific targeting.

Some aspects of this disclosure relate to the recognition that the activity of cytidine deaminase enzymes such as APOBEC enzymes can be directed to a specific site in genomic DNA. Without wishing to be bound by any particular theory, advantages of using Cas9 as a recognition agent include (1) the sequence specificity of Cas9 can be easily altered by simply changing the sgRNA sequence; and (2) Cas9 binds to its target sequence by denaturing the dsDNA, resulting in a stretch of DNA that is single-stranded and therefore a viable substrate for the deaminase. It should be understood that other catalytic domains, or catalytic domains from other deaminases, can also be used to generate fusion proteins with Cas9, and that the disclosure is not limited in this regard.

Some aspects of this disclosure are based on the recognition that Cas9:deaminase fusion proteins can efficiently deaminate nucleotides. In view of the results provided herein regarding the nucleotides that can be targeted by Cas9:deaminase fusion proteins, a person of skill in the art will be able to design suitable guide RNAs to target the fusion proteins to a target sequence that comprises a nucleotide to be deaminated.

In some embodiments, the deaminase domain and the Cas9 domain are fused to each other via a linker. Various linker lengths and flexibilities between the deaminase domain (e.g., AID) and the Cas9 domain can be employed (e.g., ranging from very flexible linkers of the form $(GGGGS)_n$ (SEQ ID NO: 110), $(GGS)_n$ (SEQ ID NO: 112) and $(G)_n$ (SEQ ID NO: 118) to more rigid linkers of the form $(EAAAK)_n$ (SEQ ID NO: 111), $(SGGS)_n$ (SEQ ID NO: 113), SGSETPGTSESATPES (SEQ ID NO: 114) (see, e.g., Guilinger J P, Thompson D B, Liu D R. Fusion of catalytically inactive Cas9 to FokI nuclease improves the specificity of genome modification. *Nat. Biotechnol.* 2014; 32(6): 577-82; the entire contents are incorporated herein by reference) and (XP). (SEQ ID NO: 120))[36] in order to achieve the optimal length for deaminase activity for the specific application. In some embodiments, the linker comprises a $(GGS)_n$ motif (SEQ ID NO: 112), wherein n is 1, 3, or 7. In some embodiments, the linker comprises a (an SGSETPGTSESATPES (SEQ ID NO: 114) motif.

Some exemplary suitable nucleic-acid editing domains, e.g., deaminases and deaminase domains, that can be fused to Cas9 domains according to aspects of this disclosure are provided below. It should be understood that, in some embodiments, the active domain of the respective sequence can be used, e.g., the domain without a localizing signal (nuclear localization sequence, without nuclear export signal, cytoplasmic localizing signal).

Adenosine Deaminases

Some aspects of the disclosure provide adenosine deaminases. In some embodiments, the adenosine deaminases provided herein are capable of deaminating adenosine. In some embodiments, the adenosine deaminases provided herein are capable of deaminating adenosine in a deoxyadenosine residue of DNA. The adenosine deaminase may be derived from any suitable organism (e.g., *E. coli*). In some embodiments, the adenosine deaminase is a naturally-occurring adenosine deaminase that includes one or more mutations corresponding to any of the mutations provided herein (e.g., mutations in ecTadA). One of skill in the art will be able to identify the corresponding residue in any homologous protein and in the respective encoding nucleic acid by methods well known in the art, e.g., by sequence alignment and determination of homologous residues. Accordingly, one of skill in the art would be able to generate mutations in any naturally-occurring adenosine deaminase (e.g., having homology to ecTadA) that corresponds to any of the mutations described herein, e.g., any of the mutations identified in ecTadA. In some embodiments, the adenosine deaminase is from a prokaryote. In some embodiments, the adenosine deaminase is from a bacterium. In some embodiments, the adenosine deaminase is from *Escherichia coli, Staphylococcus aureus, Salmonella typhi, Shewanella putrefaciens, Haemophilus influenzae, Caulobacter crescentus*, or *Bacillus subtilis*. In some embodiments, the adenosine deaminase is from *E. coli*.

In some embodiments, the adenosine deaminase comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the amino acid sequences set forth in any one of SEQ ID NOs: 15, or to any of the adenosine deaminases provided herein. It should be appreciated that adenosine deaminases provided herein may include one or more mutations (e.g., any of the mutations provided herein). The disclosure provides any deaminase domains with a certain percent identity plus any of the mutations or combinations thereof described herein. In some embodiments, the adenosine deaminase comprises an amino acid sequence that has 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50, or more mutations compared to any one of the amino acid sequences set forth in SEQ ID NO: 15 or any of the adenosine deaminases provided herein. In some embodiments, the adenosine deaminase comprises an amino acid sequence that has at least 5, at least 10, at least 15, at least 20, at least 25, at least 30, at least 35, at least 40, at least 45, at least 50, at least 60, at least 70, at least 80, at least 90, at least 100, at least 110, at least 120, at least 130, at least 140, at least 150, at least 160, or at least 170 identical contiguous amino acid residues as compared to any one of the amino acid sequences set forth in SEQ ID NO: 15 or any of the adenosine deaminases provided herein.

In some embodiments, the adenosine deaminase comprises a D108X mutation in ecTadA SEQ ID NO: 15, or a corresponding mutation in another adenosine deaminase, where X indicates any amino acid other than the corresponding amino acid in the wild-type adenosine deaminase. In some embodiments, the adenosine deaminase comprises a D108G, D108N, D108V, D108A, or D108Y mutation in SEQ ID NO: 15, or a corresponding mutation in another adenosine deaminase. It should be appreciated, however, that additional deaminases may similarly be aligned to identify homologous amino acid residues that can be mutated as provided herein.

In some embodiments, the adenosine deaminase comprises an A106X mutation in ecTadA SEQ ID NO: 15, or a corresponding mutation in another adenosine deaminase, where X indicates any amino acid other than the corresponding amino acid in the wild-type adenosine deaminase. In some embodiments, the adenosine deaminase comprises an A106V mutation in SEQ ID NO: 15, or a corresponding mutation in another adenosine deaminase.

In some embodiments, the adenosine deaminase comprises a E155X mutation in SEQ ID NO: 15, or a corresponding mutation in another adenosine deaminase, where the presence of X indicates any amino acid other than the corresponding amino acid in the wild-type adenosine deaminase. In some embodiments, the adenosine deaminase comprises a E155D, E155G, or E155V mutation in SEQ ID NO: 15, or a corresponding mutation in another adenosine deaminase.

In some embodiments, the adenosine deaminase comprises a D147X mutation in SEQ ID NO: 15, or a corresponding mutation in another adenosine deaminase, where the presence of X indicates any amino acid other than the corresponding amino acid in the wild-type adenosine deaminase. In some embodiments, the adenosine deaminase comprises a D147Y, mutation in SEQ ID NO: 15, or a corresponding mutation in another adenosine deaminase.

It should be appreciated that any of the mutations provided herein (e.g., based on the ecTadA amino acid sequence of SEQ ID NO: 15) may be introduced into other adenosine deaminases, such as S. aureus TadA (saTadA), or other adenosine deaminases (e.g., bacterial adenosine deaminases). It would be apparent to the skilled artisan how to identify amino acid residues from other adenosine deaminases that are homologous to the mutated residues in ecTadA. Thus, any of the mutations identified in ecTadA may be made in other adenosine deaminases that have homologous amino acid residues. It should also be appreciated that any of the mutations provided herein may be made individually or in any combination in ecTadA or another adenosine deaminase. For example, an adenosine deaminase may contain a D108N, a A106V, a E155V, and/or a D147Y mutation in ecTadA SEQ ID NO: 15, or a corresponding mutation in another adenosine deaminase. In some embodiments, an adenosine deaminase comprises the following group of mutations (groups of mutations are separated by a ";") in ecTadA SEQ ID NO: 15, or corresponding mutations in another adenosine deaminase:

D108N and A106V; D108N and E155V; D108N and D147Y; A106V and E155V; A106V and D147Y; E155V and D147Y; D108N, A106V, and E55V; D108N, A106V, and D147Y; D108N, E55V, and D147Y; A106V, E55V, and D147Y; and D108N, A106V, E55V, and D147Y. It should be appreciated, however, that any combination of corresponding mutations provided herein may be made in an adenosine deaminase (e.g., ecTadA).

In some embodiments, the adenosine deaminase comprises one or more of a H8X, T17X, L18X, W23X, L34X, W45X, R51X, A56X, E59X, E85X, M94X, I95X, V102X, F104X, A106X, R107X, D108X, K110X, M118X, N127X, A138X, F149X, M151X, R153X, Q154X, I156X, and/or K157X mutation in SEQ ID NO: 15, or one or more corresponding mutations in another adenosine deaminase, where the presence of X indicates any amino acid other than the corresponding amino acid in the wild-type adenosine deaminase. In some embodiments, the adenosine deaminase comprises one or more of H8Y, T17S, L18E, W23X, L34S, W45L, R51H, A56E, or A56S, E59G, E85K, or E85G, M94L, I95I, V102A, F104L, A106V, R107C, or R107H, or R107P, D108G, or D108N, or D108V, or D108A, or D108Y, K110I, M118K, N127S, A138V, F149Y, M151V, R153C, Q154L, I156D, and/or K157R mutation in SEQ ID NO: 15, or one or more corresponding mutations in another adenosine deaminase.

In some embodiments, the adenosine deaminase comprises one or more of a H8X, D108X, and/or N127X mutation in SEQ ID NO: 15, or one or more corresponding mutations in another adenosine deaminase, where X indicates the presence of any amino acid. In some embodiments, the adenosine deaminase comprises one or more of a H8Y, D108N, and/or N127S mutation in SEQ ID NO: 15, or one or more corresponding mutations in another adenosine deaminase.

In some embodiments, the adenosine deaminase comprises one or more of H8X, R26X, M61X, L68X, M70X, A106X, D108X, A109X, N127X, D147X, R152X, Q154X, E155X, K161X, Q163X, and/or T166X mutation in SEQ ID NO: 15, or one or more corresponding mutations in another adenosine deaminase, where X indicates the presence of any amino acid other than the corresponding amino acid in the wild-type adenosine deaminase. In some embodiments, the adenosine deaminase comprises one or more of H8Y, R26W, M61I, L68Q, M70V, A106T, D108N, A109T, N127S, D147Y, R152C, Q154H or Q154R, E155G or E155V or E155D, K161Q, Q163H, and/or T166P mutation in SEQ ID NO: 15, or one or more corresponding mutations in another adenosine deaminase.

In some embodiments, the adenosine deaminase comprises one, two, three, four, five, or six mutations selected from the group consisting of H8X, D108X, N127X, D147X, R152X, and Q154X in SEQ ID NO: 15, or a corresponding mutation or mutations in another adenosine deaminase, where X indicates the presence of any amino acid other than the corresponding amino acid in the wild-type adenosine deaminase. In some embodiments, the adenosine deaminase comprises one, two, three, four, five, six, seven, or eight mutations selected from the group consisting of H8X, M61X, M70X, D108X, N127X, Q154X, E155X, and Q163X in SEQ ID NO: 15, or a corresponding mutation or mutations in another adenosine deaminase, where X indicates the presence of any amino acid other than the corresponding amino acid in the wild-type adenosine deaminase. In some embodiments, the adenosine deaminase comprises one, two, three, four, or five, mutations selected from the group consisting of H8X, D108X, N127X, E155X, and T166X in SEQ ID NO: 15, or a corresponding mutation or mutations in another adenosine deaminase, where X indicates the presence of any amino acid other than the corresponding amino acid in the wild-type adenosine deaminase. In some embodiments, the adenosine deaminase comprises one, two, three, four, five, or six mutations selected from the group consisting of H8X, A106X, D108X, N127X, E155X, and K161X in SEQ ID NO: 15, or a corresponding mutation or mutations in another adenosine deaminase, where X indicates the presence of any amino acid other than the corresponding amino acid in the wild-type adenosine deaminase. In some embodiments, the adenosine deaminase comprises one, two, three, four, five, six, seven, or eight mutations selected from the group consisting of H8X, R126X, L68X, D108X, N127X, D147X, and E155X in SEQ ID NO: 15, or a corresponding mutation or mutations in another adenosine deaminase, where X indicates the presence of any amino acid other than the corresponding amino acid in the wild-type adenosine deaminase. In some embodiments, the adenosine deaminase comprises one, two, three, four, or five, mutations selected from the group consisting of H8X, D108X, A109X, N127X, and E155X in SEQ ID NO: 15, or a corresponding mutation or mutations in another adenosine deaminase, where X indicates the presence of any amino acid other than the corresponding amino acid in the wild-type adenosine deaminase.

In some embodiments, the adenosine deaminase comprises one, two, three, four, five, or six mutations selected from the group consisting of H8Y, D108N, N127S, D147Y, R152C, and Q154H in SEQ ID NO: 15, or a corresponding mutation or mutations in another adenosine deaminase. In some embodiments, the adenosine deaminase comprises one, two, three, four, five, six, seven, or eight mutations selected from the group consisting of H8Y, M61I, M70V, D108N, N127S, Q154R, E155G and Q163H in SEQ ID NO: 15, or a corresponding mutation or mutations in another adenosine deaminase. In some embodiments, the adenosine deaminase comprises one, two, three, four, or five, mutations selected from the group consisting of H8Y, D108N, N127S, E155V, and T166P in SEQ ID NO: 15, or a corresponding mutation or mutations in another adenosine deaminase. In some embodiments, the adenosine deaminase comprises one, two, three, four, five, or six mutations selected from the group consisting of H8Y, A106T, D108N, N127S, E155D, and K161Q in SEQ ID NO: 15, or a corresponding mutation or mutations in another adenosine deaminase. In some embodiments, the adenosine deaminase comprises one, two, three, four, five, six, seven, or eight mutations selected from the group consisting of H8Y, R126W, L68Q, D108N, N127S, D147Y, and E155V in SEQ ID NO: 15, or a corresponding mutation or mutations in another adenosine deaminase. In some embodiments, the adenosine deaminase comprises one, two, three, four, or five, mutations selected from the group consisting of H8Y, D108N, A109T, N127S, and E155G in SEQ ID NO: 15, or a corresponding mutation or mutations in another adenosine deaminase.

Figure 16:
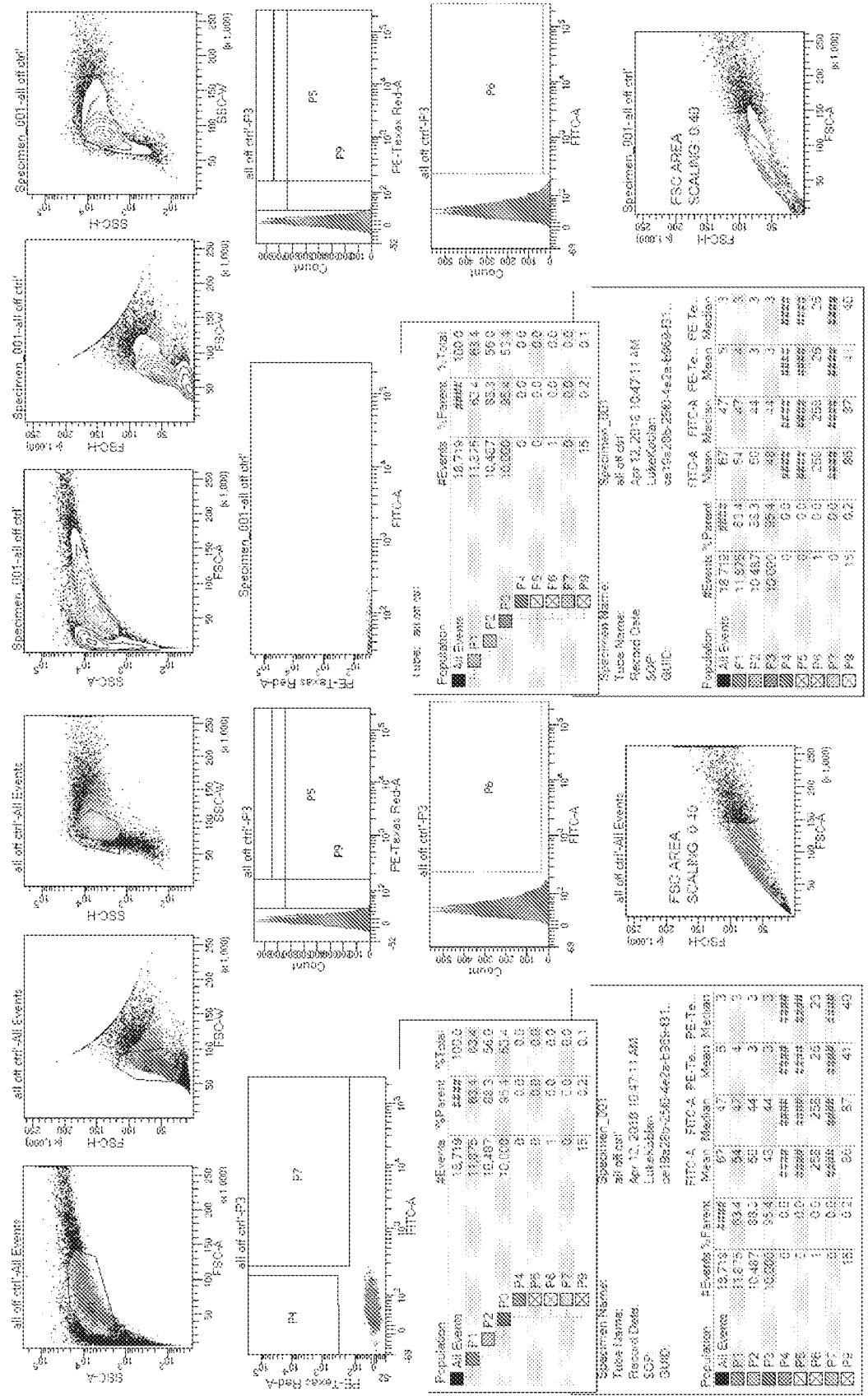
FIG. 16. Flow Sorting HEK293T negative control from FIGS. 1A-1E.
Figure 17:
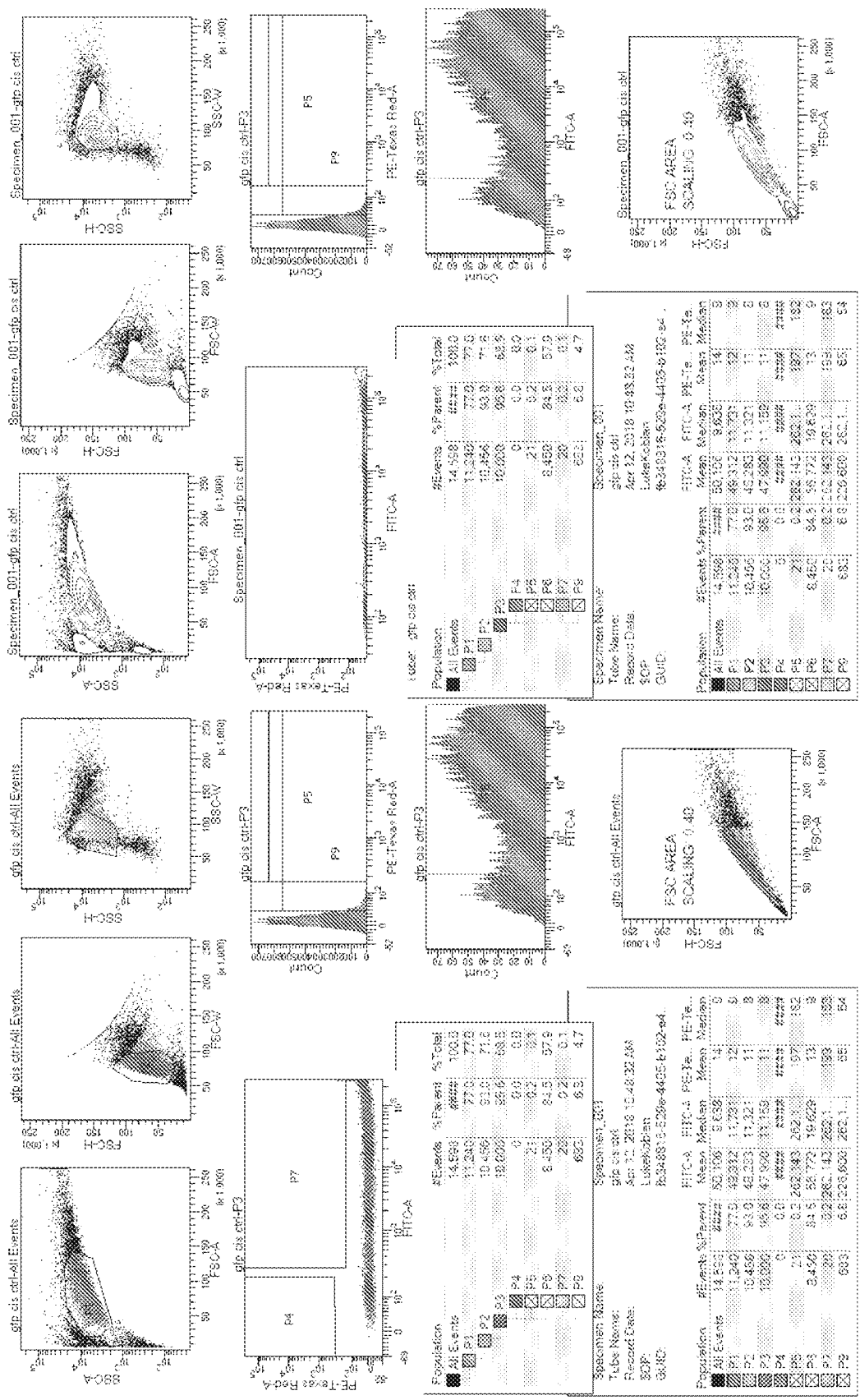
FIG. 17. Flow Sorting HEK293T GFP+ control from FIGS. 1A-1E.
Figure 18:
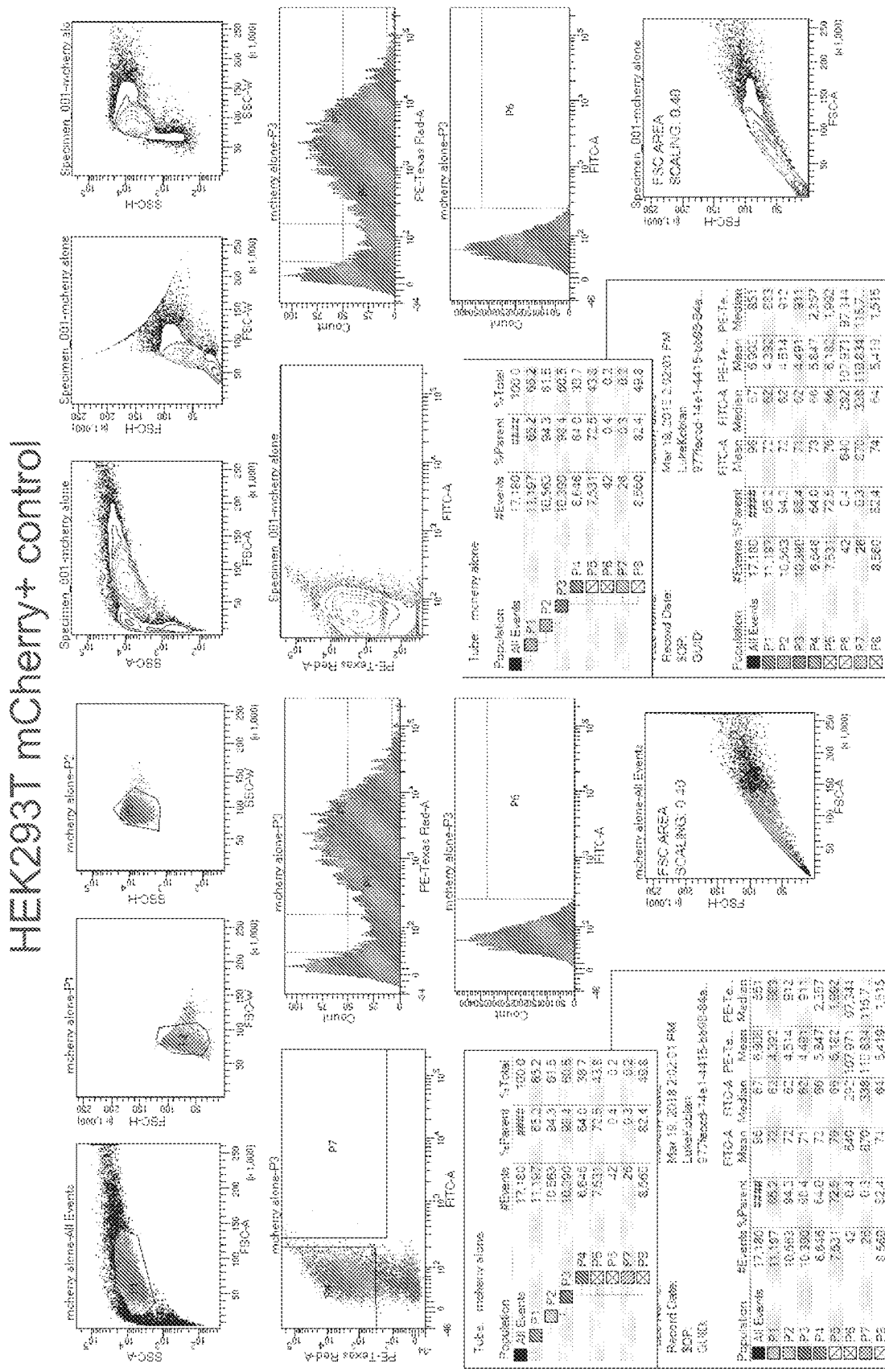
FIG. 18. Flow Sorting HEK293T mCherry+ control from FIGS. 1A-1E.
Figure 19:
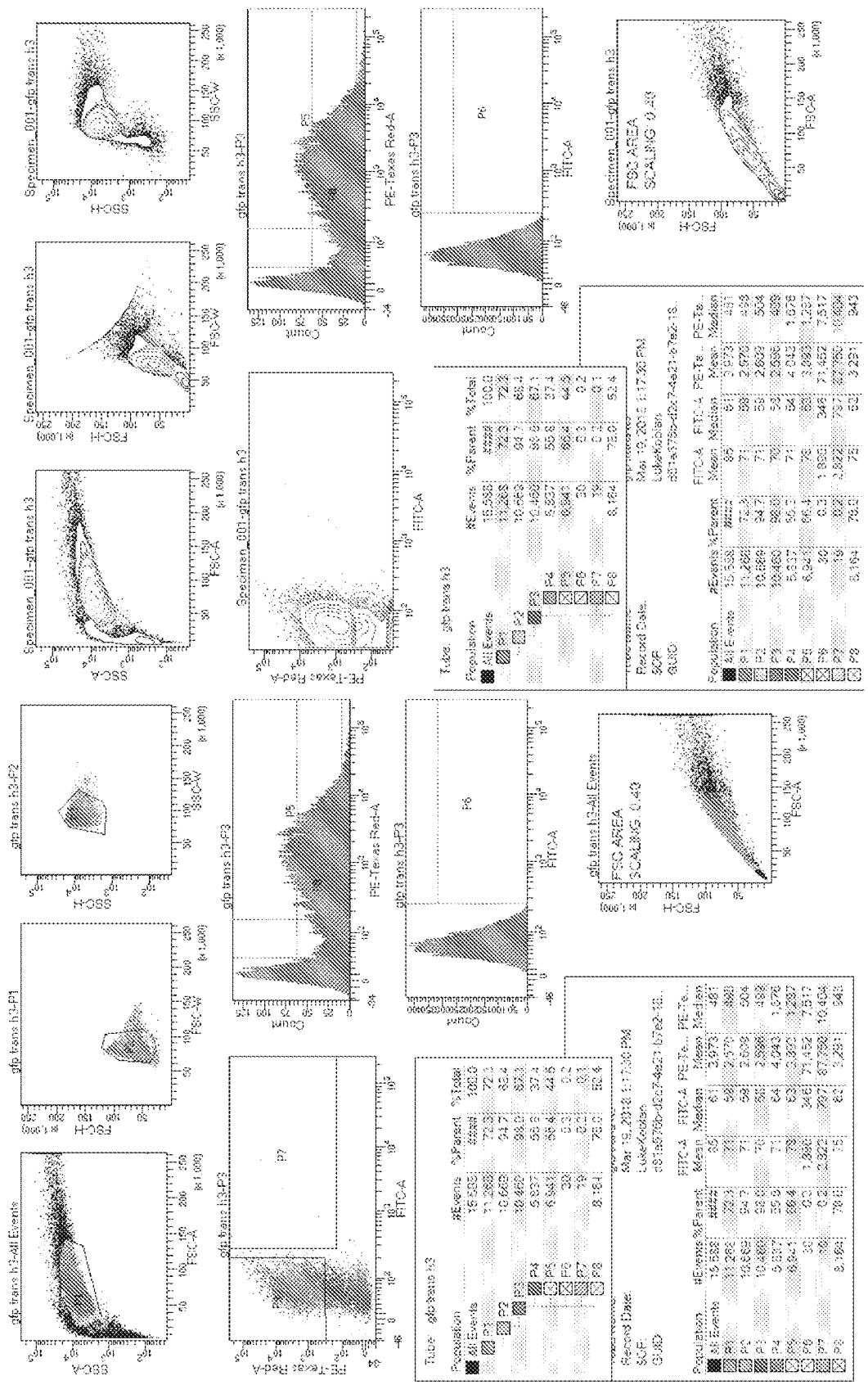
FIG. 19. Flow Sorting Example HEK293T In trans sort from FIGS. 1A-1E.
Figure 20:
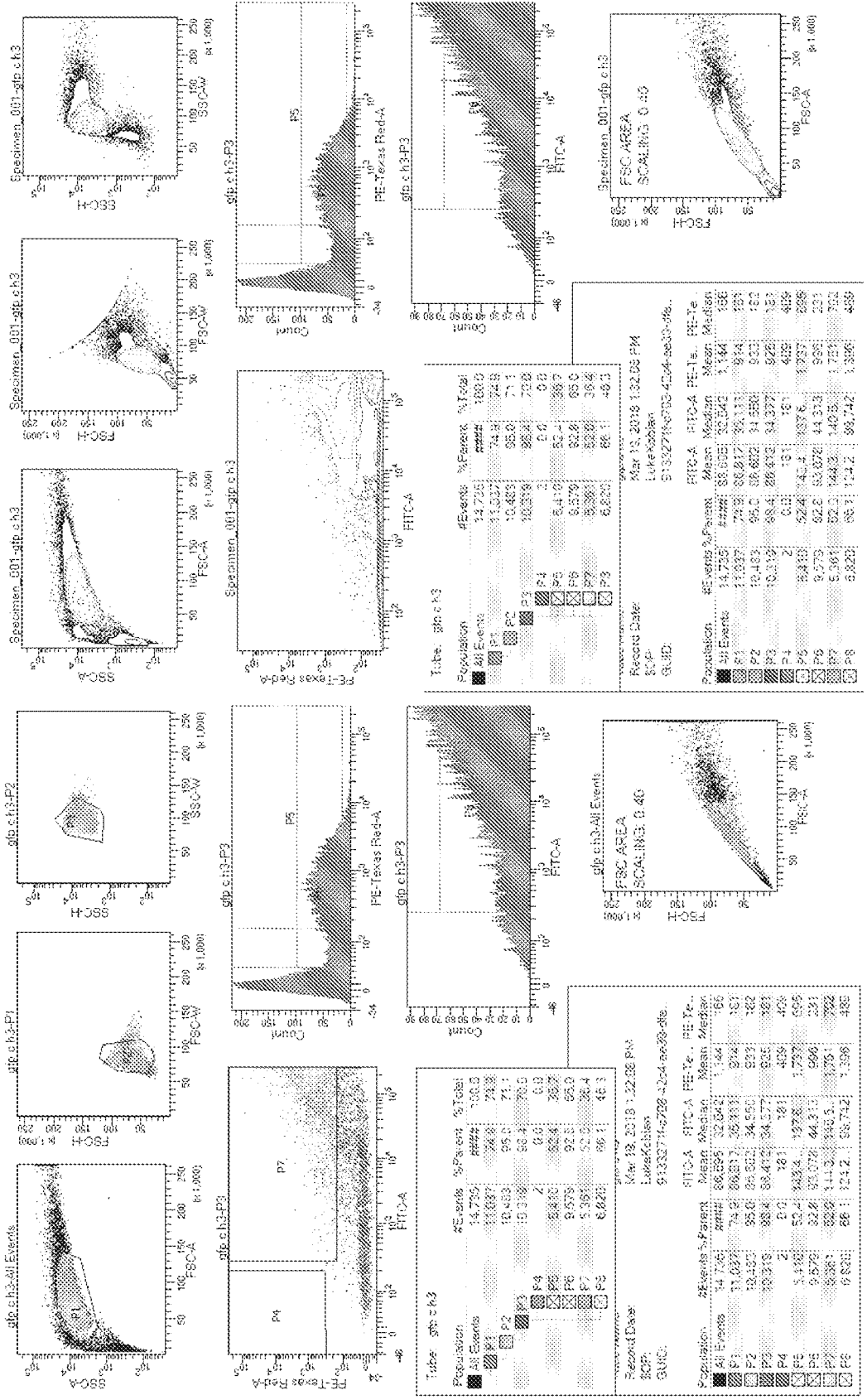
FIG. 20 Flow Sorting Example HEK293T In cis sort from FIGS. 1A-1E.
Figure 21:
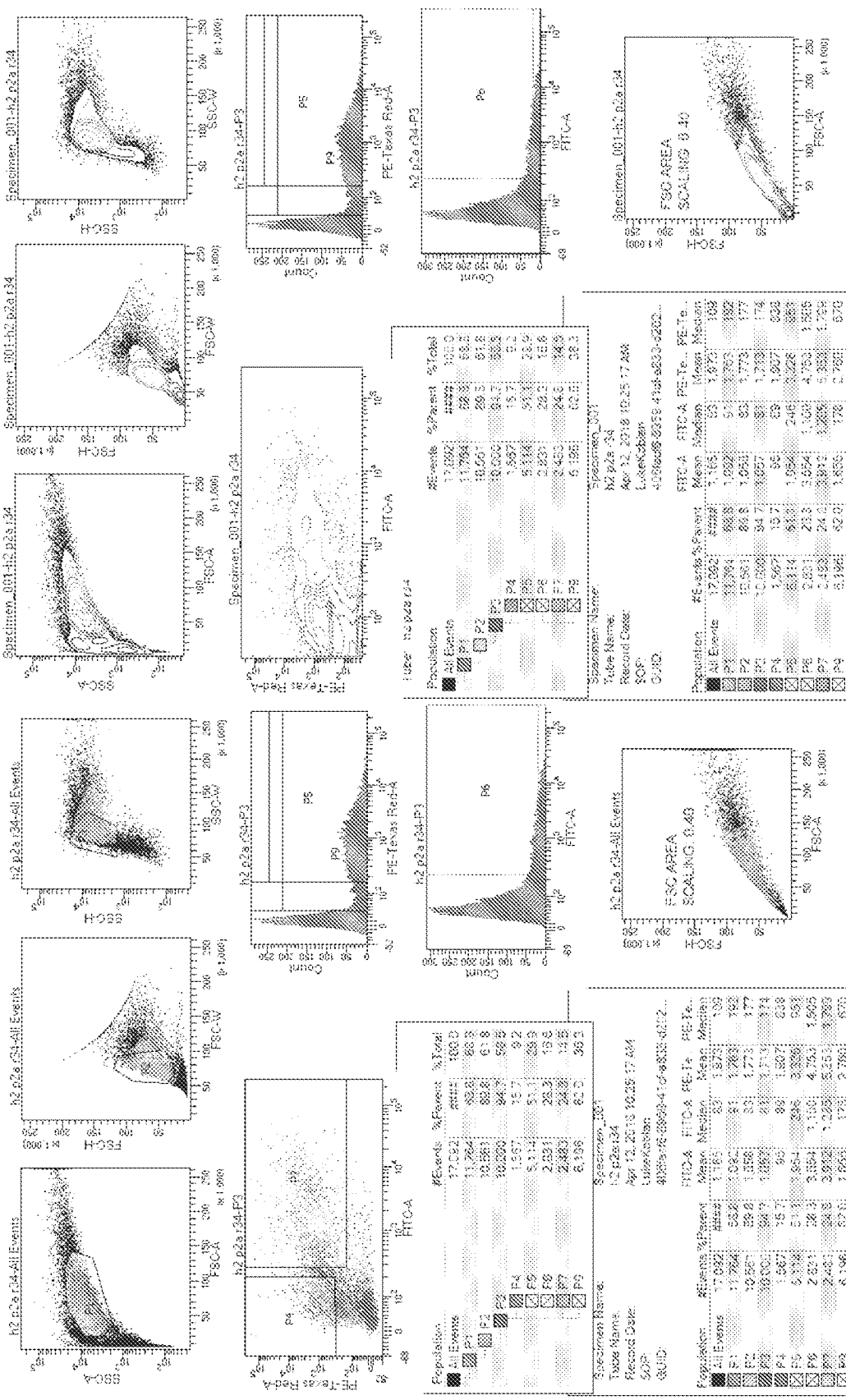
FIG. 21. Flow Sorting Example HEK293T P2A sort (BE4-P2A-GFP) from FIGS. 1A-1E.
Figure 22:
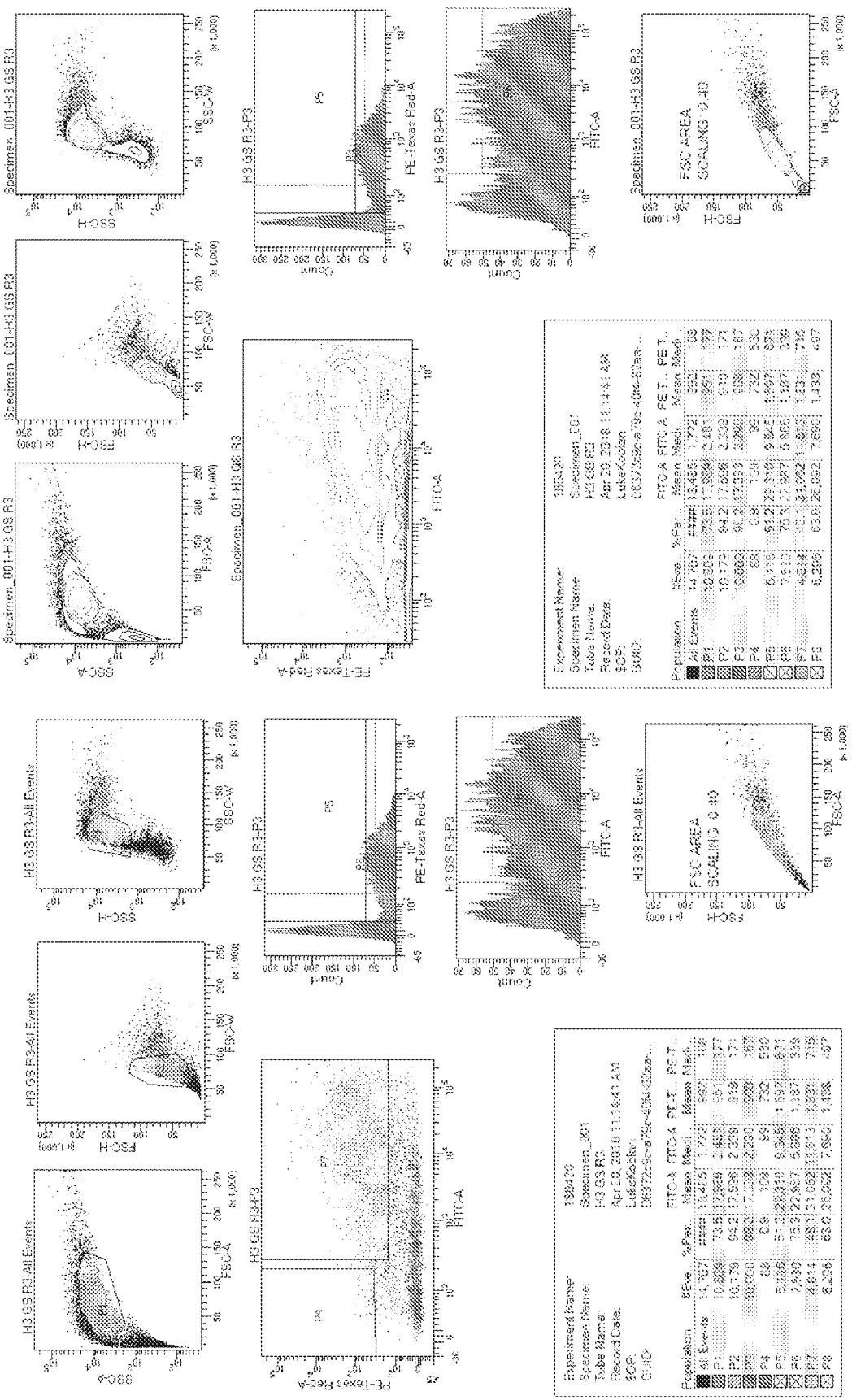
FIG. 22. Flow Sorting Example HEK293T P2A sort (BE4 max-P2A-GFP) from FIGS. 1A-1E.
Figure 23:
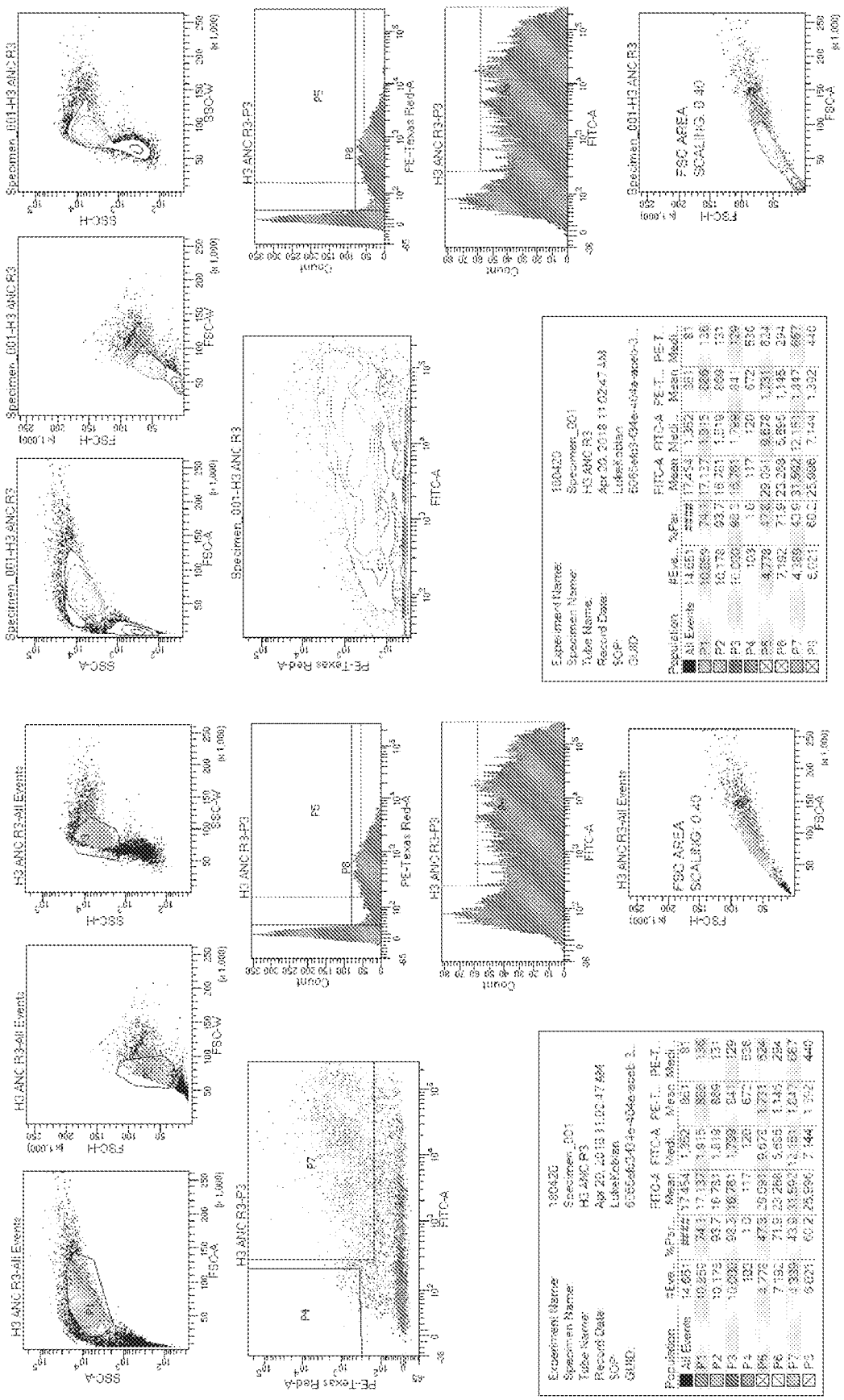
FIG. 23. Flow Sorting Example HEK293T P2A sort (AncBE4 max-P2A-GFP) from FIGS. 1A-1E.
Figure 24:
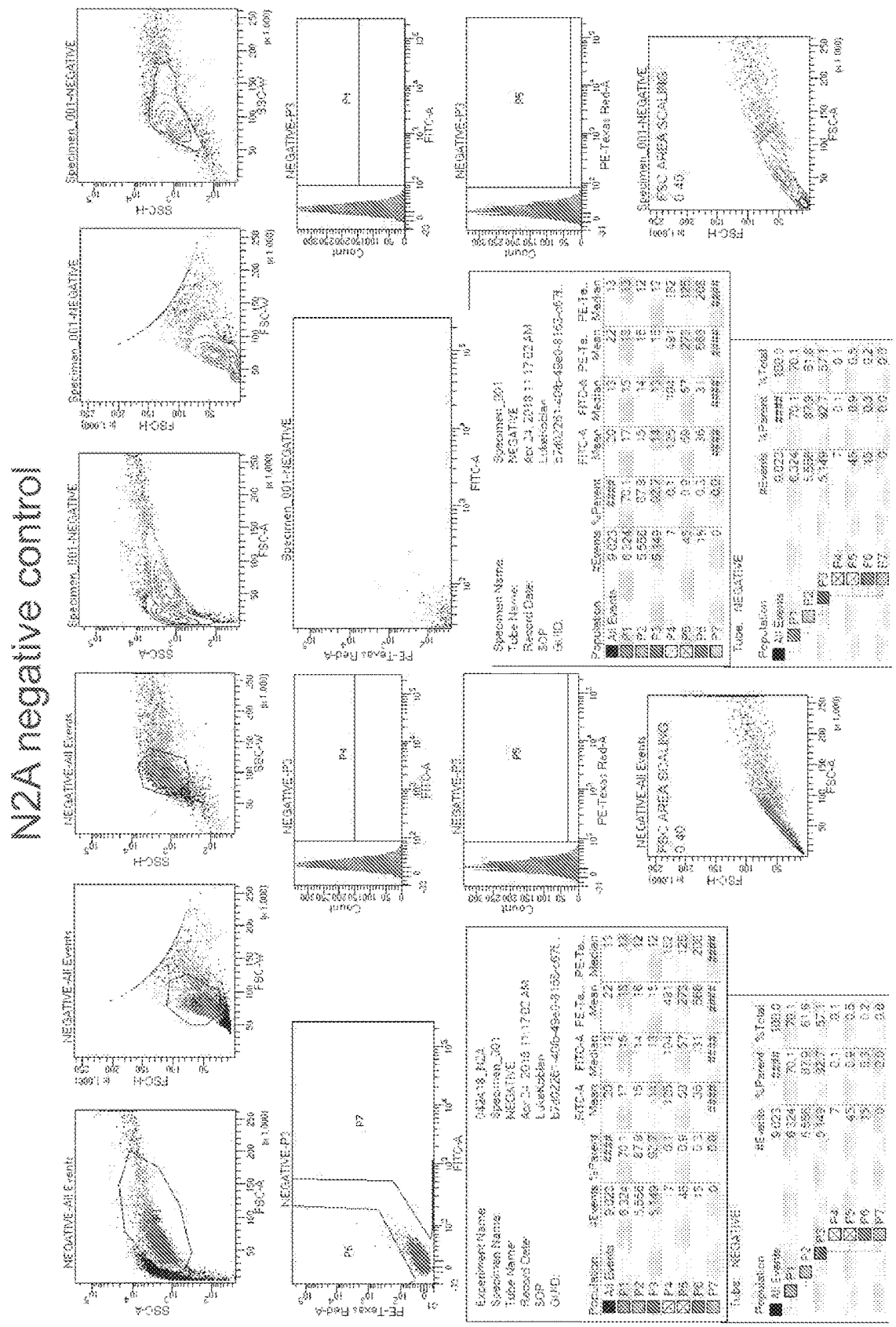
FIG. 24. Flow Sorting N2A negative control, SCN9a sites 1 and 2, from FIGS. 4A-4D.
Figure 25:
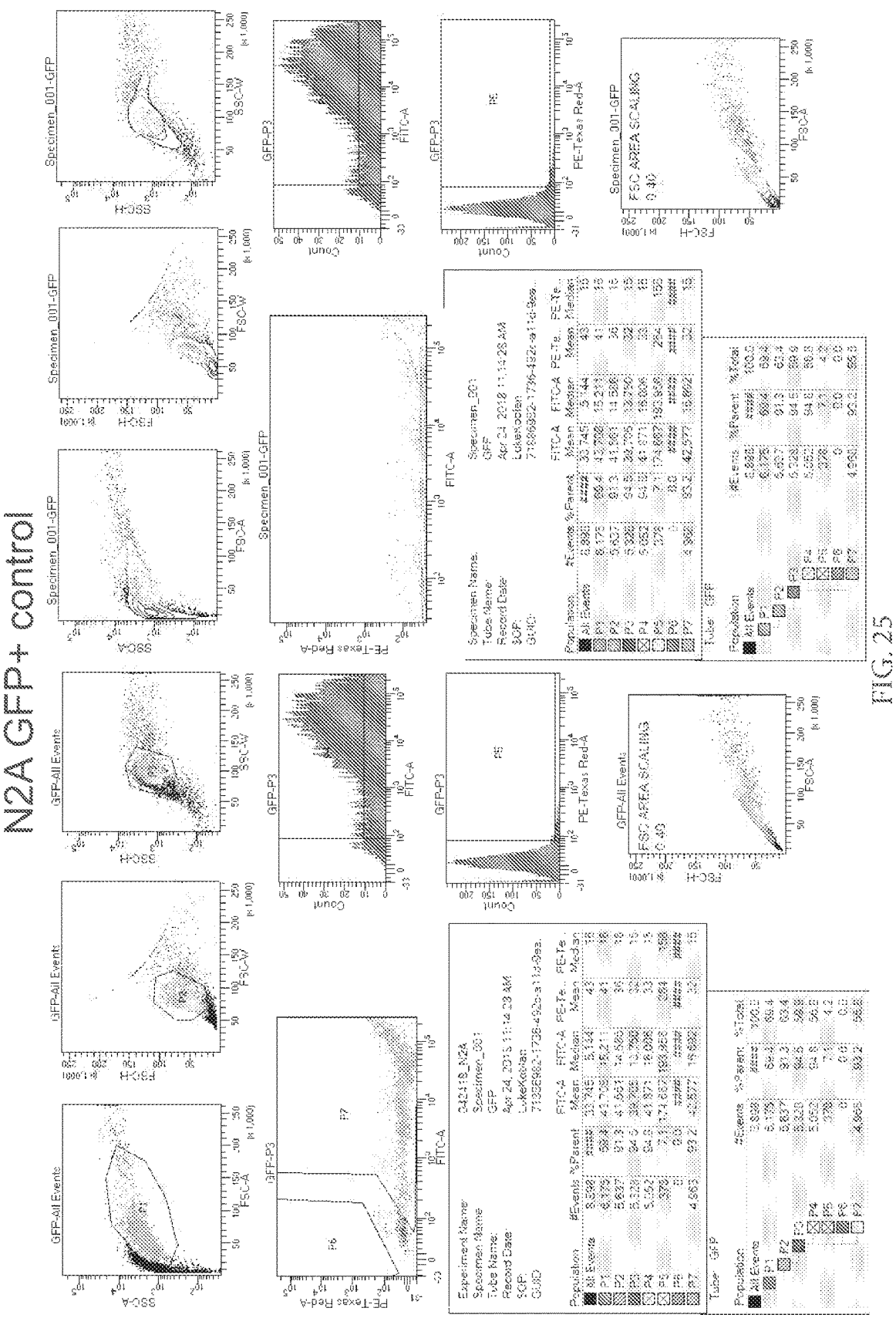
FIG. 25. Flow Sorting N2A GFP+ control, SCN9a sites 1 and 2, from FIGS. 4A-4D.
Figure 26:
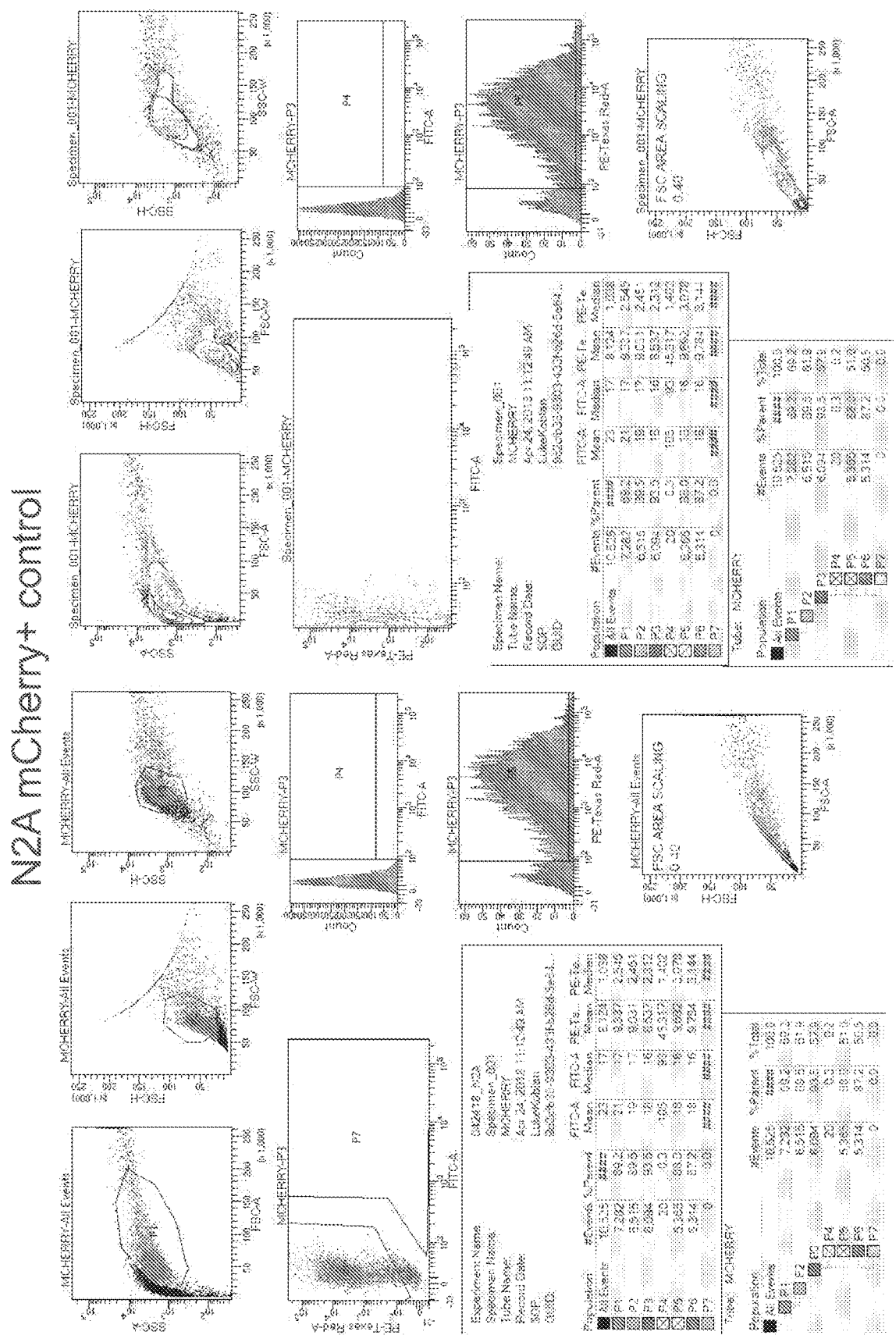
FIG. 26. Flow Sorting N2A mCherry+ control, SCN9a sites 1 and 2, from FIGS. 4A-4D.
Figure 27:
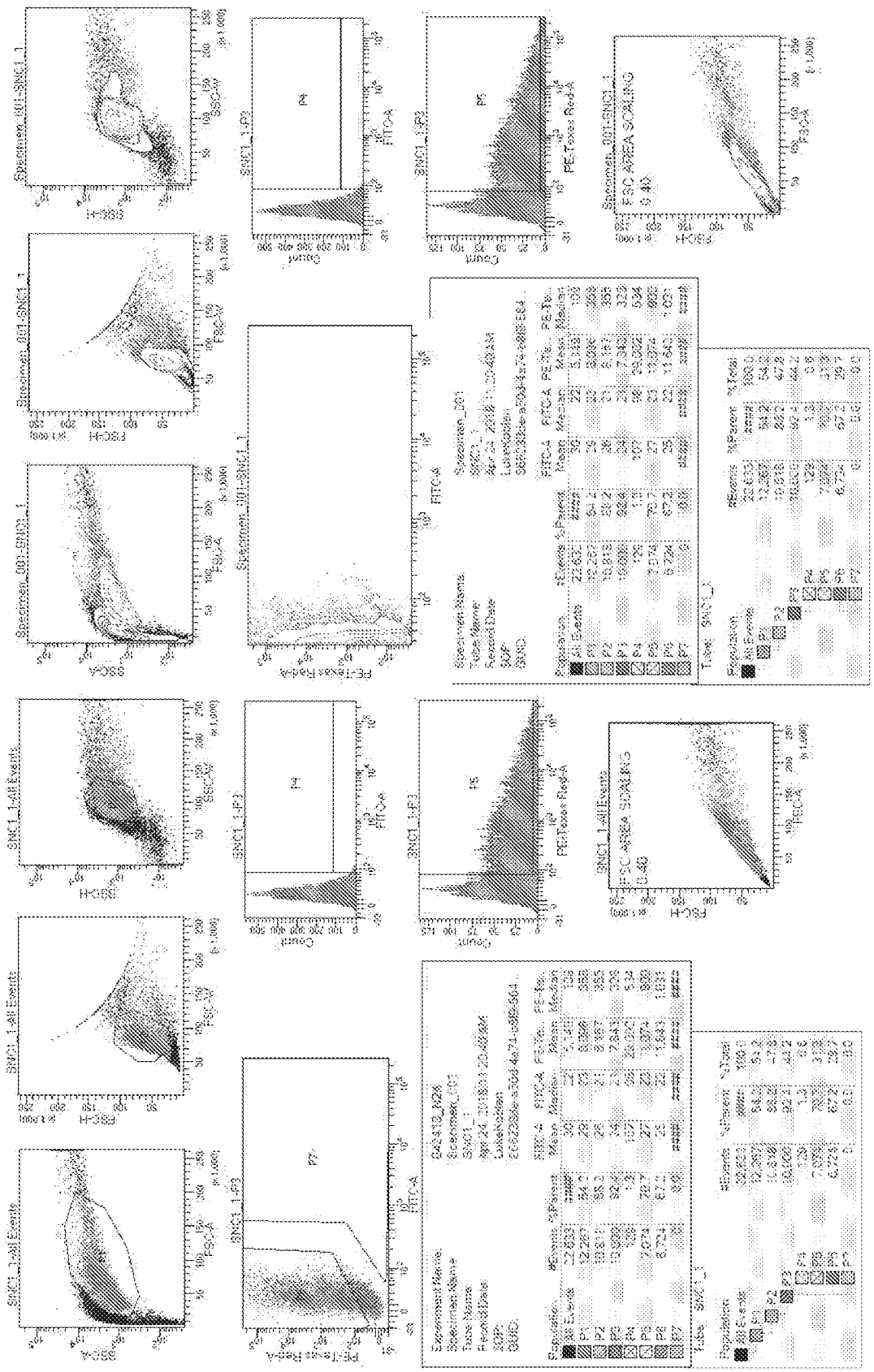
FIG. 27. Flow Sorting Example N2A BE4 mCherry In trans sort, SCN9a sites 1 and 2, from FIGS. 4A-4D.
Figure 28:
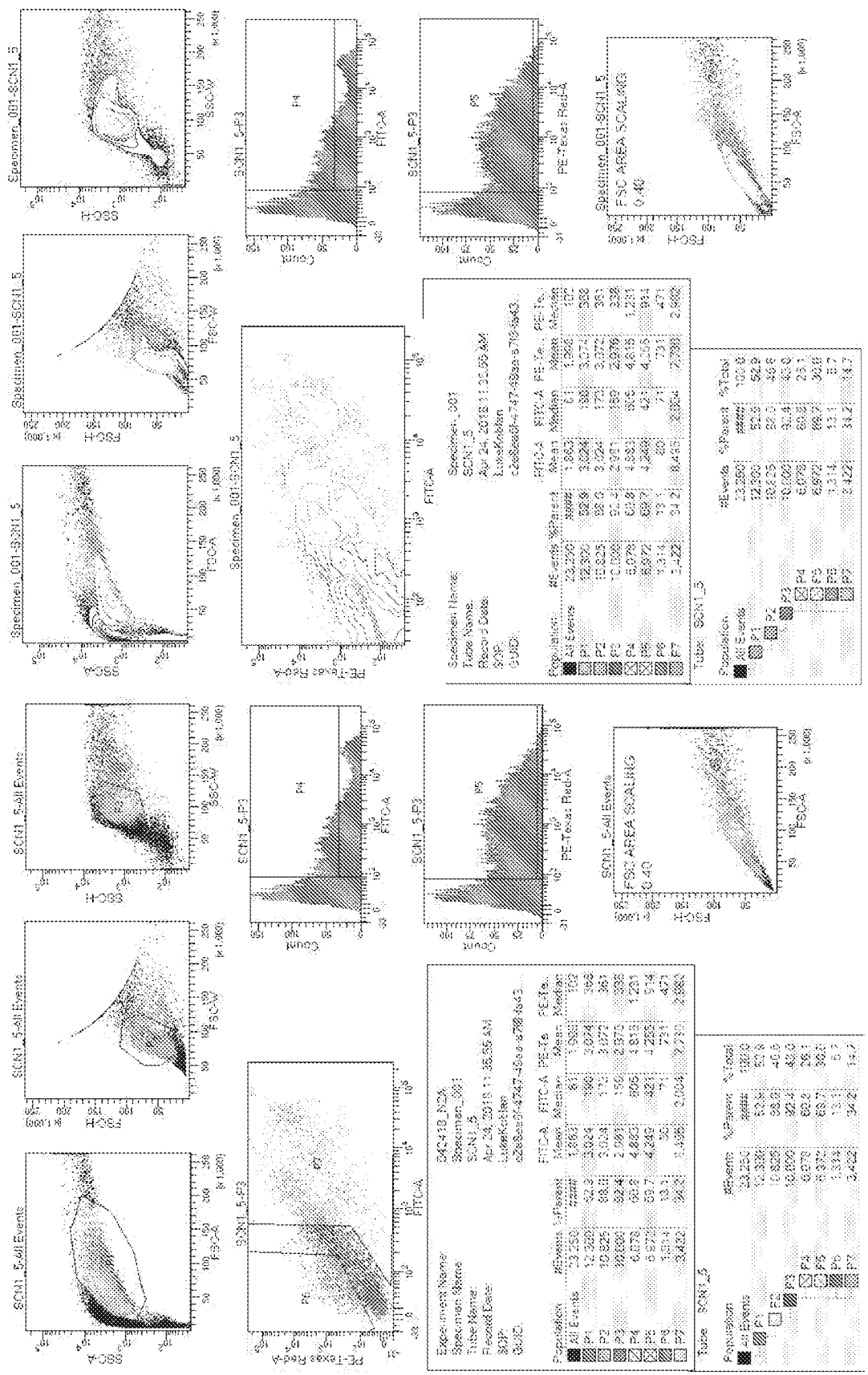
FIG. 28. Flow Sorting Example N2A P2A sort (BE4 max-P2A-GFP), SCN9a sites 1 and 2, from FIGS. 4A-4D.
Figure 29:
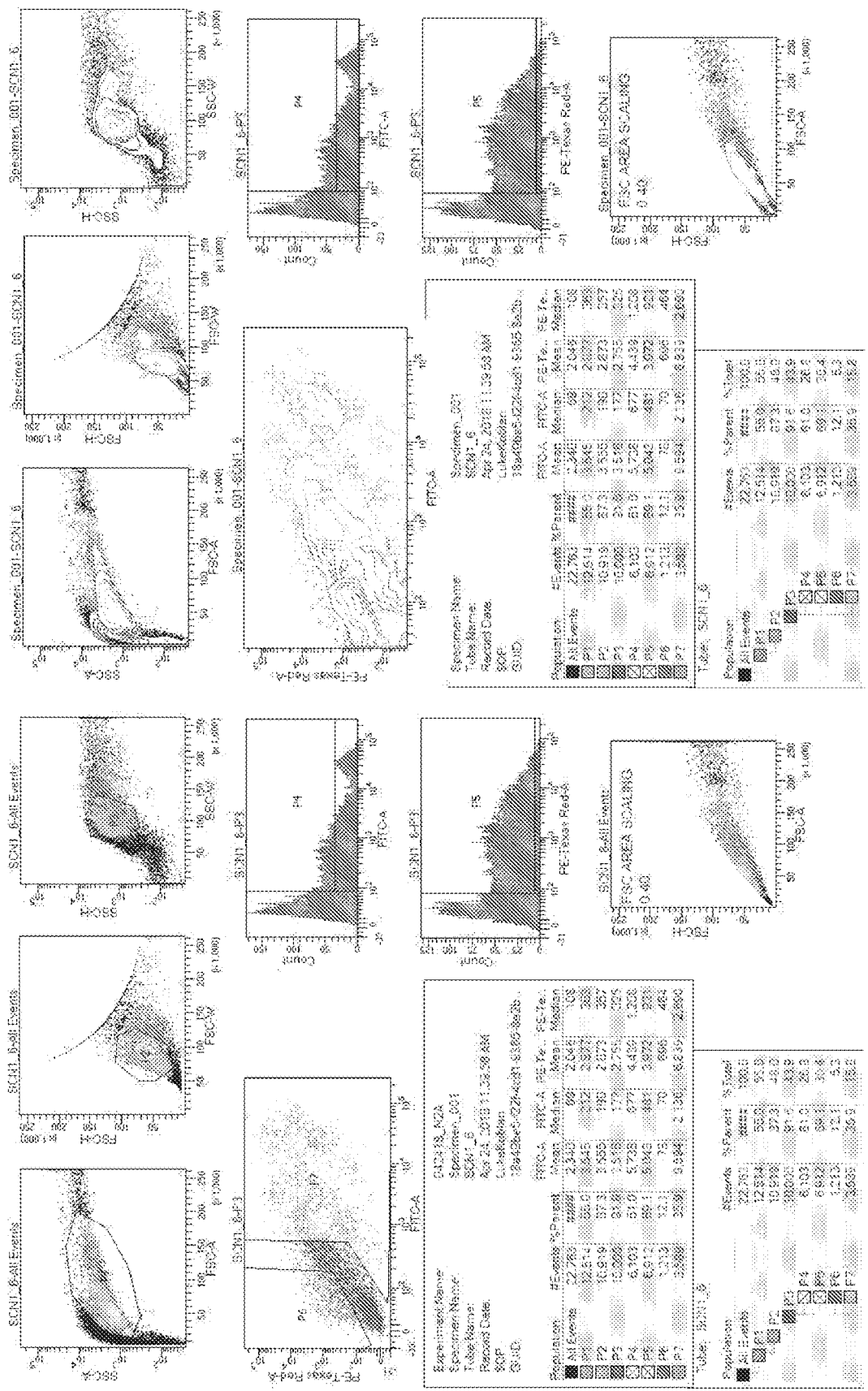
FIG. 29. Flow Sorting Example N2A P2A sort (AncBE4 max-P2A-GFP), SCN9a sites 1 and 2, from FIGS. 4A-4D.
Figure 30:
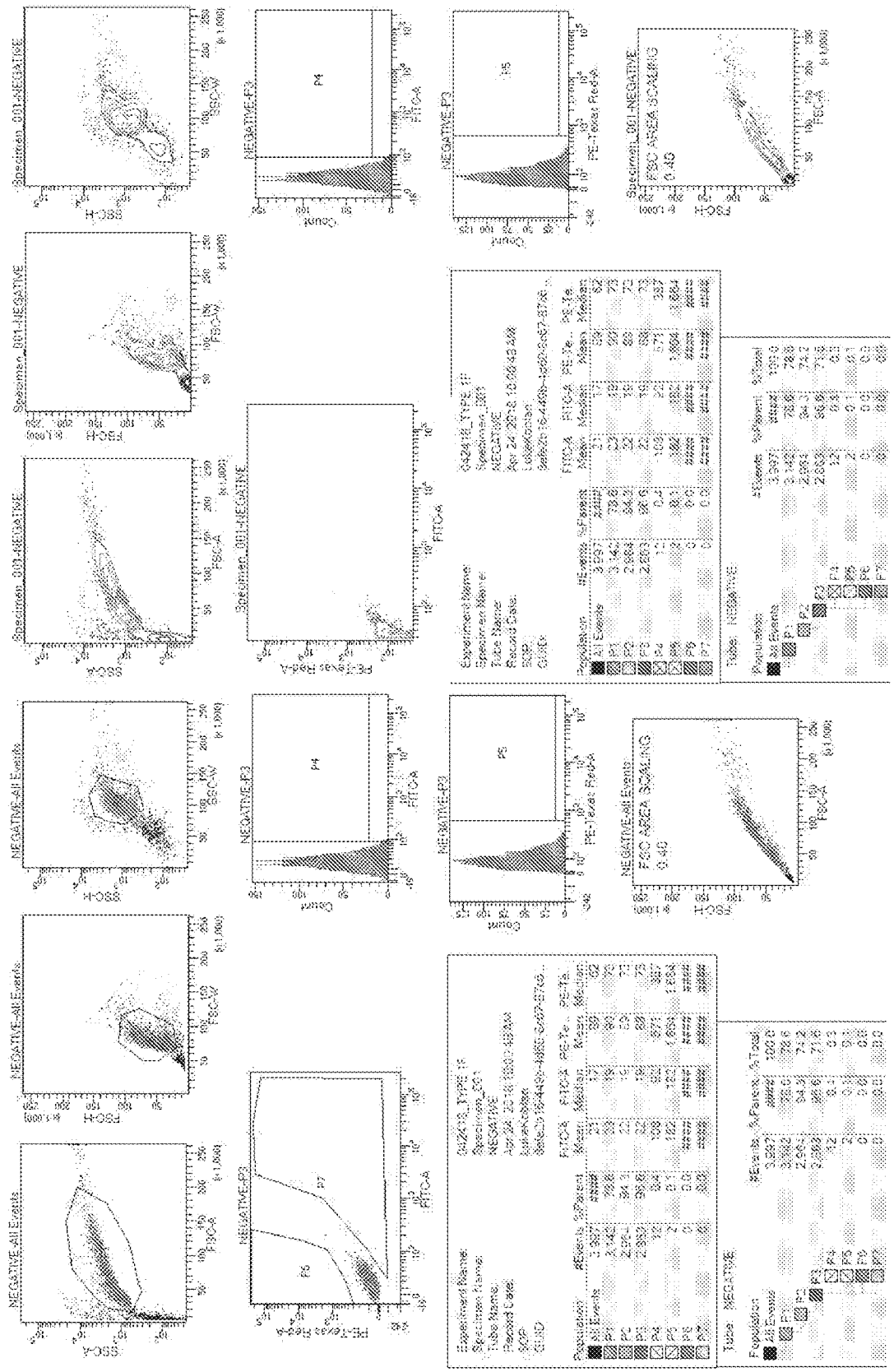
FIG. 30. Flow Sorting CGD Type 1F Fibroblast negative control from FIGS. 4A-4D.
Figure 31:
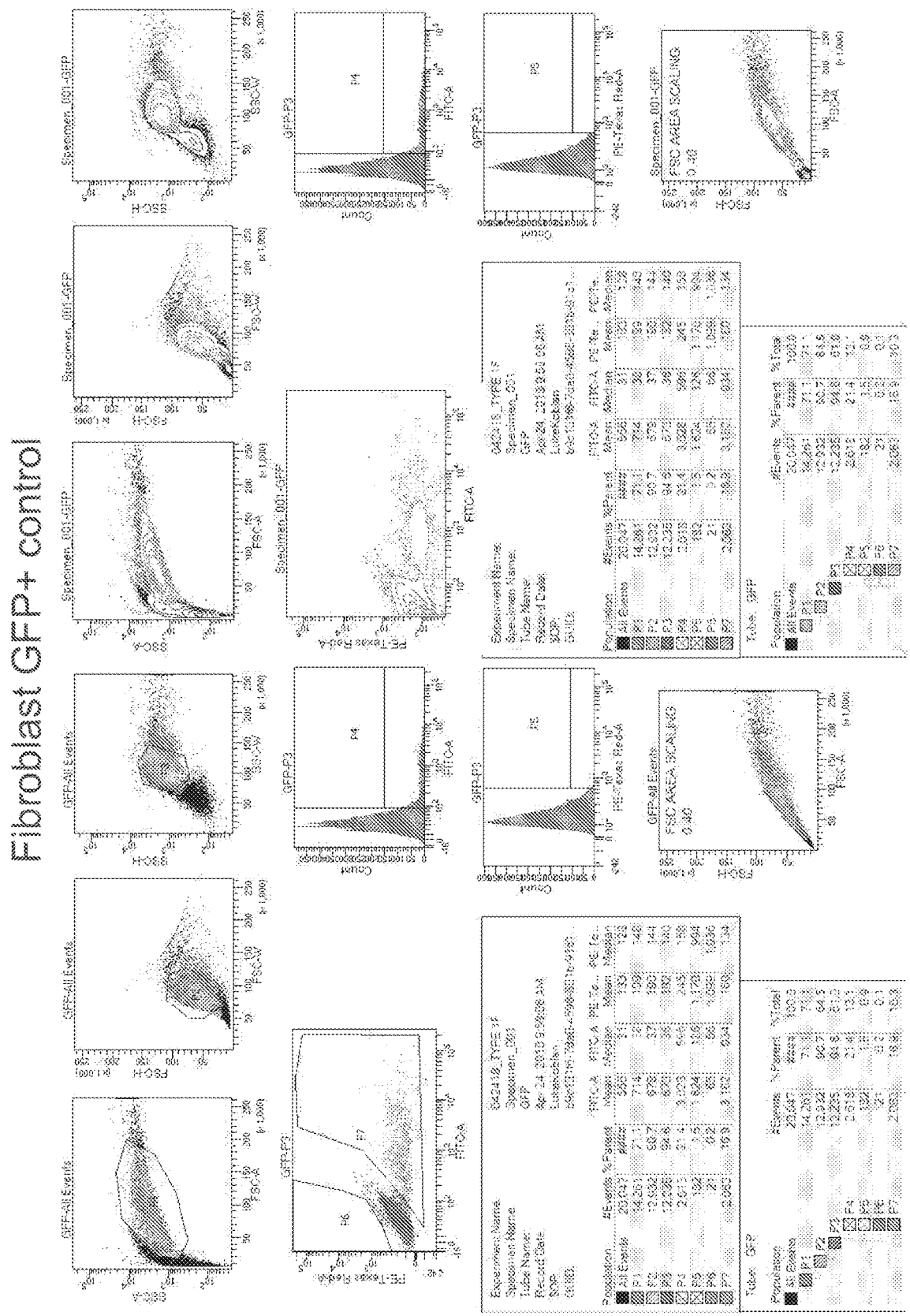
FIG. 31. Flow Sorting CGD Type 1F Fibroblast GFP+ control from FIGS. 4A-4D.
Figure 32:
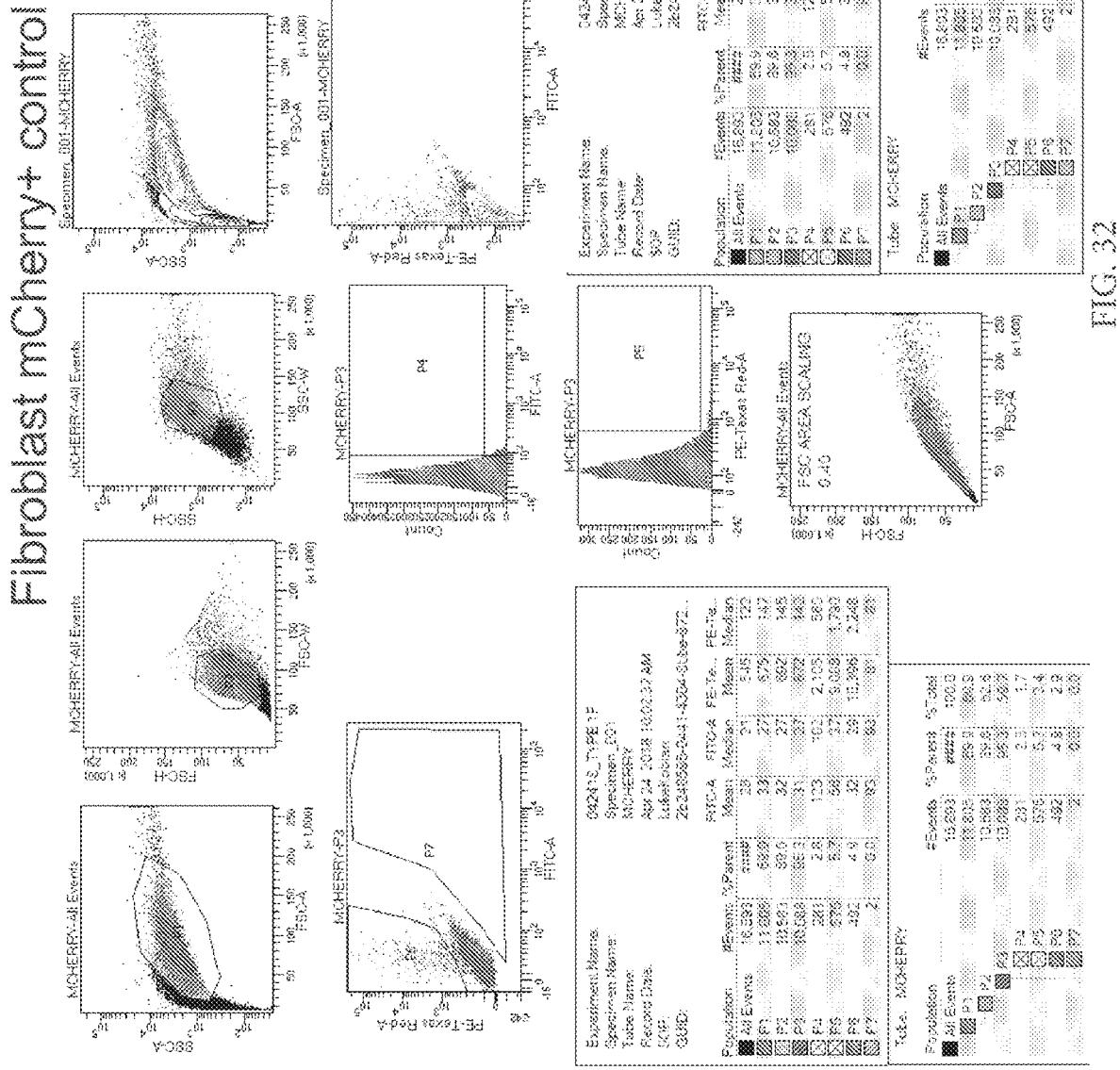
FIG. 32. Flow Sorting CGD Type 1F Fibroblast mCherry+ control from FIGS. 4A-4D.
Figure 33:
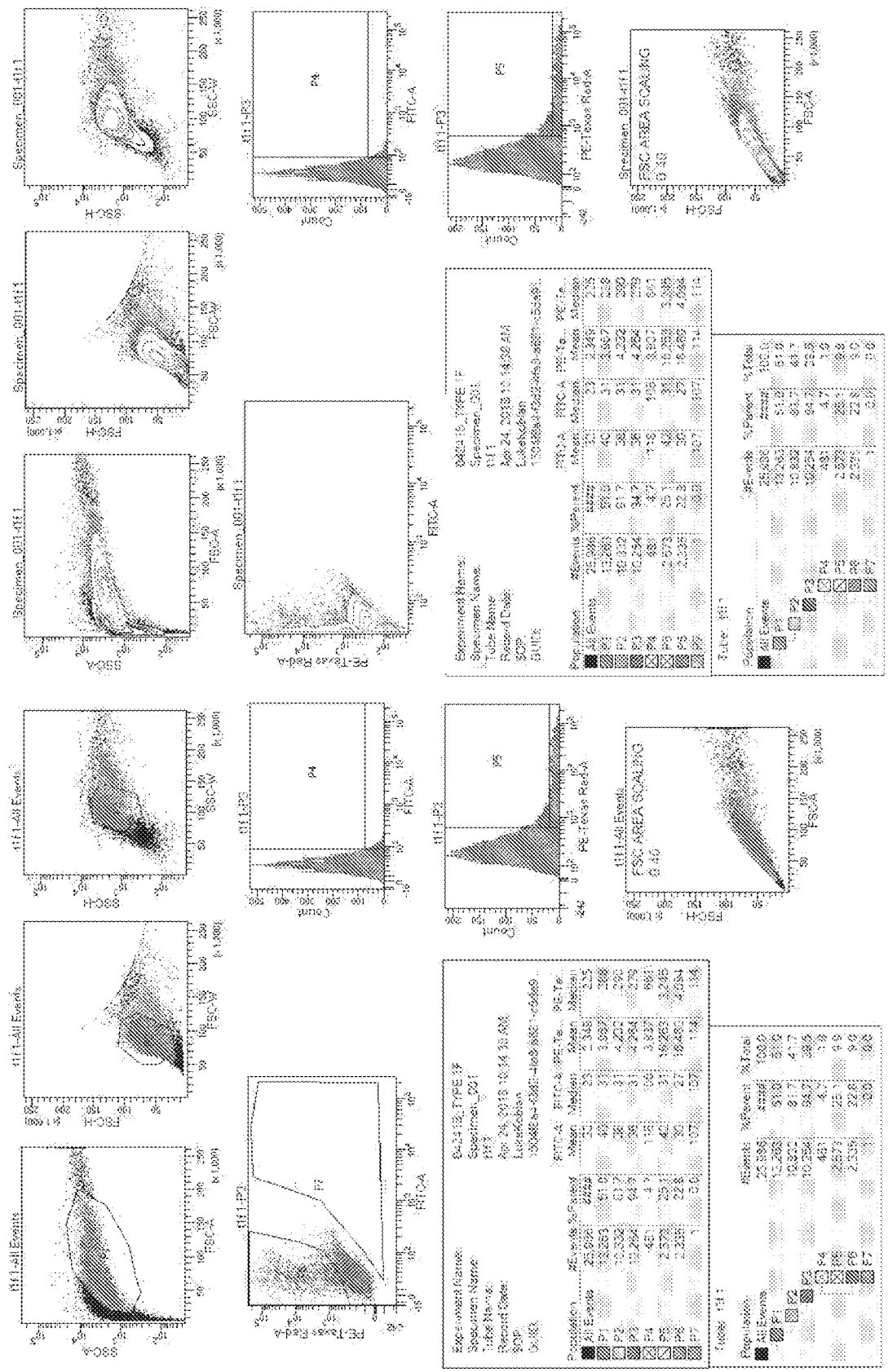
FIG. 33. Flow Sorting CGD Type 1F Example Fibroblast In trans sort (BE4) from FIGS. 4A-4D.
Figure 34:
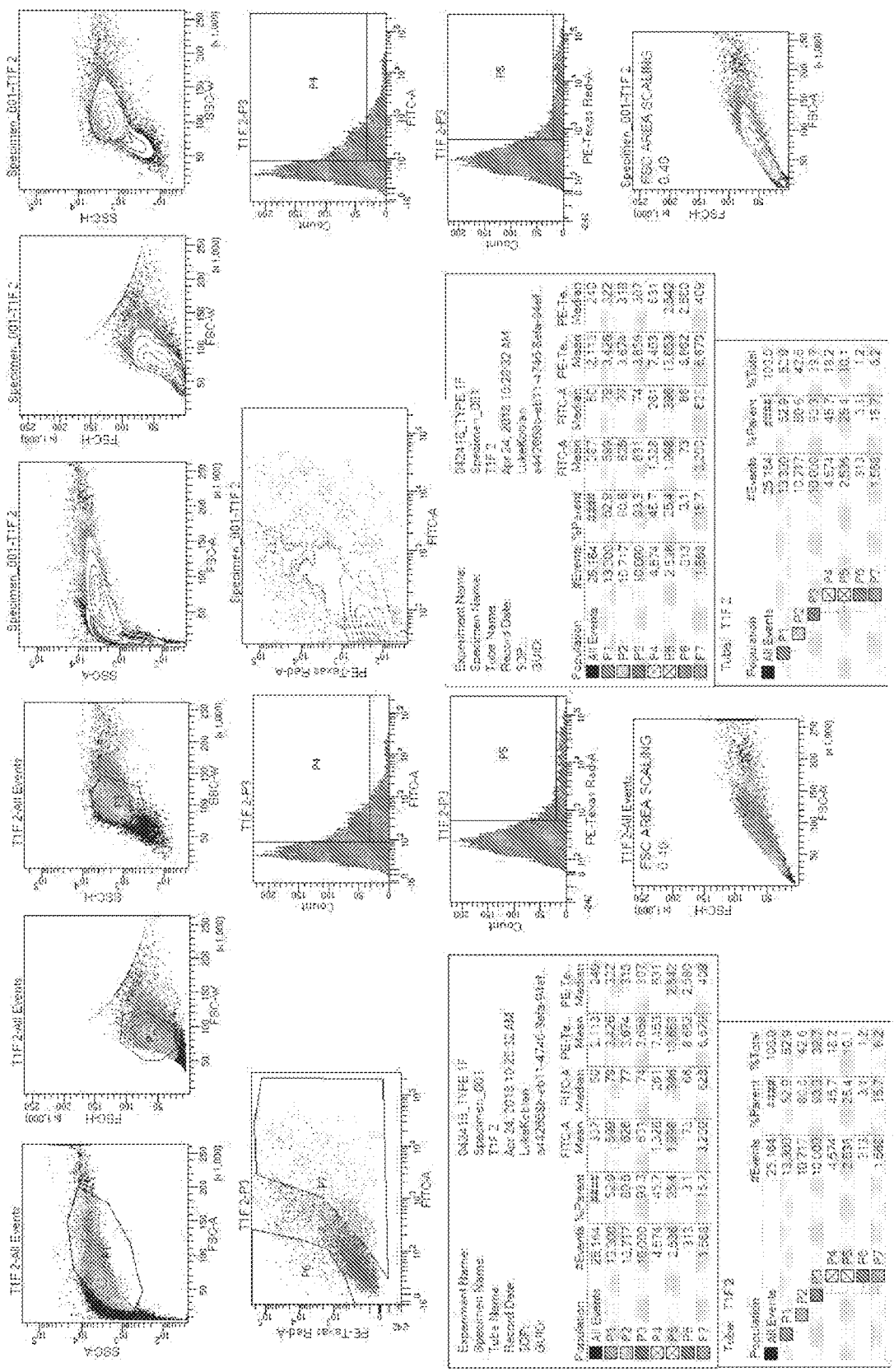
FIG. 34. Flow Sorting CGD Type 1F Example Fibroblast P2A sort (BE4 max-P2A-GFP) from FIG. 4.
Figure 35:
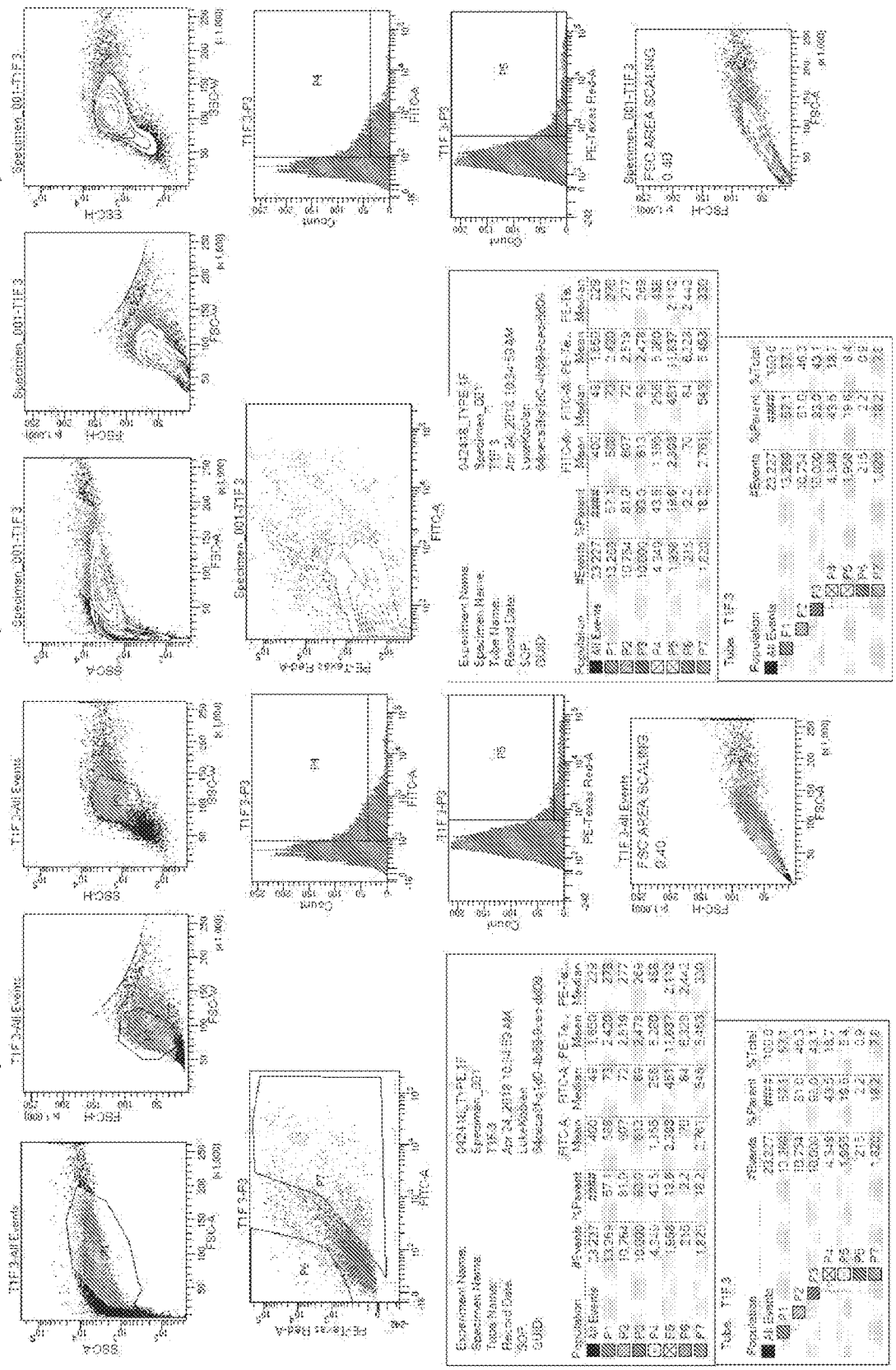
FIG. 35. Flow Sorting CGD Type 1F Example Fibroblast P2A sort (AncBE4 max-P2A-GFP) from FIGS. 4A-4D.

In some embodiments, the adenosine deaminase comprises one or more of the mutations provided in FIG. 16 corresponding to SEQ ID NO: 15, or one or more corresponding mutations in another adenosine deaminase. In some embodiments, the adenosine deaminase comprises a D108N, D108G, or D108V mutation in SEQ ID NO: 15, or corresponding mutations in another adenosine deaminase. In some embodiments, the adenosine deaminase comprises a A106V and D108N mutation in SEQ ID NO: 15, or corresponding mutations in another adenosine deaminase. In some embodiments, the adenosine deaminase comprises R107C and D108N mutations in SEQ ID NO: 15, or corresponding mutations in another adenosine deaminase. In some embodiments, the adenosine deaminase comprises a H8Y, D108N, N127S, D147Y, and Q154H mutation in SEQ ID NO: 15, or corresponding mutations in another adenosine deaminase. In some embodiments, the adenosine deaminase comprises a H8Y, R24W, D108N, N127S, D147Y, and E155V mutation in SEQ ID NO: 15, or corresponding mutations in another adenosine deaminase. In some embodiments, the adenosine deaminase comprises a D108N, D147Y, and E155V mutation in SEQ ID NO: 15, or corresponding mutations in another adenosine deaminase. In some embodiments, the adenosine deaminase comprises a H8Y, D108N, and S127S mutation in SEQ ID NO: 15, or corresponding mutations in another adenosine deaminase. In some embodiments, the adenosine deaminase comprises a A106V, D108N, D147Y and E155V mutation in SEQ ID NO: 15, or corresponding mutations in another adenosine deaminase.

In some embodiments, the adenosine deaminase comprises one or more of a, S2X, H8X, I49X, L84X, H123X, N127X, I156X and/or K160X mutation in SEQ ID NO: 15, or one or more corresponding mutations in another adenosine deaminase, where the presence of X indicates any amino acid other than the corresponding amino acid in the wild-type adenosine deaminase. In some embodiments, the adenosine deaminase comprises one or more of S2A, H8Y, I49F, L84F, H123Y, N127S, I156F and/or K160S mutation in SEQ ID NO: 15, or one or more corresponding mutations in another adenosine deaminase.

In some embodiments, the adenosine deaminase comprises an L84X mutation in ecTadA SEQ ID NO: 15, or a corresponding mutation in another adenosine deaminase, where X indicates any amino acid other than the corresponding amino acid in the wild-type adenosine deaminase. In some embodiments, the adenosine deaminase comprises an L84F mutation in SEQ ID NO: 15, or a corresponding mutation in another adenosine deaminase.

In some embodiments, the adenosine deaminase comprises an H123X mutation in ecTadA SEQ ID NO: 15, or a corresponding mutation in another adenosine deaminase, where X indicates any amino acid other than the corresponding amino acid in the wild-type adenosine deaminase. In some embodiments, the adenosine deaminase comprises an H123Y mutation in SEQ ID NO: 15, or a corresponding mutation in another adenosine deaminase.

In some embodiments, the adenosine deaminase comprises an I157X mutation in ecTadA SEQ ID NO: 15, or a corresponding mutation in another adenosine deaminase, where X indicates any amino acid other than the corresponding amino acid in the wild-type adenosine deaminase. In some embodiments, the adenosine deaminase comprises an I157F mutation in SEQ ID NO: 15, or a corresponding mutation in another adenosine deaminase.

In some embodiments, the adenosine deaminase comprises one, two, three, four, five, six, or seven mutations selected from the group consisting of L84X, A106X, D108X, H123X, D147X, E155X, and I156X in SEQ ID NO: 15, or a corresponding mutation or mutations in another adenosine deaminase, where X indicates the presence of any amino acid other than the corresponding amino acid in the wild-type adenosine deaminase. In some embodiments, the adenosine deaminase comprises one, two, three, four, five, or six mutations selected from the group consisting of S2X, I49X, A106X, D108X, D147X, and E155X in SEQ ID NO: 15, or a corresponding mutation or mutations in another adenosine deaminase, where X indicates the presence of any amino acid other than the corresponding amino acid in the wild-type adenosine deaminase. In some embodiments, the adenosine deaminase comprises one, two, three, four, or five, mutations selected from the group consisting of H8X, A106X, D108X, N127X, and K160X in SEQ ID NO: 15, or a corresponding mutation or mutations in another adenosine deaminase, where X indicates the presence of any amino acid other than the corresponding amino acid in the wild-type adenosine deaminase.

In some embodiments, the adenosine deaminase comprises one, two, three, four, five, six, or seven mutations selected from the group consisting of L84F, A106V, D108N, H123Y, D147Y, E155V, and I156F in SEQ ID NO: 15, or a corresponding mutation or mutations in another adenosine deaminase. In some embodiments, the adenosine deaminase comprises one, two, three, four, five, or six mutations selected from the group consisting of S2A, I49F, A106V, D108N, D147Y, and E155V in SEQ ID NO: 15, or a corresponding mutation or mutations in another adenosine deaminase. In some embodiments, the adenosine deaminase comprises one, two, three, four, or five, mutations selected from the group consisting of H8Y, A106T, D108N, N127S, and K160S in SEQ ID NO: 15, or a corresponding mutation or mutations in another adenosine deaminase.

In some embodiments, the adenosine deaminase comprises one or more of a, E25X, R26X, R107X, A142X, and/or A143X mutation in SEQ ID NO: 15, or one or more corresponding mutations in another adenosine deaminase, where the presence of X indicates any amino acid other than the corresponding amino acid in the wild-type adenosine deaminase. In some embodiments, the adenosine deaminase comprises one or more of E25M, E25D, E25A, E25R, E25V, E25S, E25Y, R26G, R26N, R26Q, R26C, R26L, R26K, R107P, R07K, R107A, R107N, R107W, R107H, R107S, A142N, A142D, A142G, A143D, A143G, A143E, A143L, A143W, A143M, A143S, A143Q and/or A143R mutation in SEQ ID NO: 15, or one or more corresponding mutations in another adenosine deaminase.

In some embodiments, the adenosine deaminase comprises an E25X mutation in ecTadA SEQ ID NO: 15, or a corresponding mutation in another adenosine deaminase, where X indicates any amino acid other than the corresponding amino acid in the wild-type adenosine deaminase. In some embodiments, the adenosine deaminase comprises an E25M, E25D, E25A, E25R, E25V, E25S, or E25Y mutation in SEQ ID NO: 15, or a corresponding mutation in another adenosine deaminase.

In some embodiments, the adenosine deaminase comprises an R26X mutation in ecTadA SEQ ID NO: 15, or a corresponding mutation in another adenosine deaminase, where X indicates any amino acid other than the corresponding amino acid in the wild-type adenosine deaminase. In some embodiments, the adenosine deaminase comprises an, R26G, R26N, R26Q, R26C, R26L, or R26K mutation in SEQ ID NO: 15, or a corresponding mutation in another adenosine deaminase.

In some embodiments, the adenosine deaminase comprises an R107X mutation in ecTadA SEQ ID NO: 15, or a corresponding mutation in another adenosine deaminase, where X indicates any amino acid other than the corresponding amino acid in the wild-type adenosine deaminase. In some embodiments, the adenosine deaminase comprises an R107P, R07K, R107A, R107N, R107W, R107H, or R107S mutation in SEQ ID NO: 15, or a corresponding mutation in another adenosine deaminase.

In some embodiments, the adenosine deaminase comprises an A142X mutation in ecTadA SEQ ID NO: 15, or a corresponding mutation in another adenosine deaminase, where X indicates any amino acid other than the corresponding amino acid in the wild-type adenosine deaminase. In some embodiments, the adenosine deaminase comprises an A142N, A142D, A142G, mutation in SEQ ID NO: 15, or a corresponding mutation in another adenosine deaminase.

In some embodiments, the adenosine deaminase comprises an A143X mutation in ecTadA SEQ ID NO: 15, or a corresponding mutation in another adenosine deaminase, where X indicates any amino acid other than the corresponding amino acid in the wild-type adenosine deaminase. In some embodiments, the adenosine deaminase comprises an A143D, A143G, A143E, A143L, A143W, A143M, A143S, A143Q and/or A143R mutation in SEQ ID NO: 15, or a corresponding mutation in another adenosine deaminase.

In some embodiments, the adenosine deaminase comprises one or more of a, H36X, N37X, P48X, I49X, R51X, M70X, N72X, D77X, E134X, S146X, Q154X, K157X, and/or K161X mutation in SEQ ID NO: 15, or one or more corresponding mutations in another adenosine deaminase, where the presence of X indicates any amino acid other than the corresponding amino acid in the wild-type adenosine deaminase. In some embodiments, the adenosine deaminase comprises one or more of H36L, N37T, N37S, P48T, P48L, I49V, R51H, R51L, M70L, N72S, D77G, E134G, S146R, S146C, Q154H, K157N, and/or K161T mutation in SEQ ID NO: 15, or one or more corresponding mutations in another adenosine deaminase.

In some embodiments, the adenosine deaminase comprises an H36X mutation in ecTadA SEQ ID NO: 15, or a corresponding mutation in another adenosine deaminase, where X indicates any amino acid other than the corresponding amino acid in the wild-type adenosine deaminase. In some embodiments, the adenosine deaminase comprises an H36L mutation in SEQ ID NO: 15, or a corresponding mutation in another adenosine deaminase.

In some embodiments, the adenosine deaminase comprises an N37X mutation in ecTadA SEQ ID NO: 15, or a corresponding mutation in another adenosine deaminase, where X indicates any amino acid other than the corresponding amino acid in the wild-type adenosine deaminase. In some embodiments, the adenosine deaminase comprises an N37T, or N37S mutation in SEQ ID NO: 15, or a corresponding mutation in another adenosine deaminase.

In some embodiments, the adenosine deaminase comprises an P48X mutation in ecTadA SEQ ID NO: 15, or a corresponding mutation in another adenosine deaminase, where X indicates any amino acid other than the corresponding amino acid in the wild-type adenosine deaminase. In some embodiments, the adenosine deaminase comprises an P48T, or P48L mutation in SEQ ID NO: 15, or a corresponding mutation in another adenosine deaminase.

In some embodiments, the adenosine deaminase comprises an R51X mutation in ecTadA SEQ ID NO: 15, or a corresponding mutation in another adenosine deaminase, where X indicates any amino acid other than the corresponding amino acid in the wild-type adenosine deaminase. In some embodiments, the adenosine deaminase comprises an R51H, or R51L mutation in SEQ ID NO: 15, or a corresponding mutation in another adenosine deaminase.

In some embodiments, the adenosine deaminase comprises an S146X mutation in ecTadA SEQ ID NO: 15, or a corresponding mutation in another adenosine deaminase, where X indicates any amino acid other than the corresponding amino acid in the wild-type adenosine deaminase. In some embodiments, the adenosine deaminase comprises an S146R, or S146C mutation in SEQ ID NO: 15, or a corresponding mutation in another adenosine deaminase.

In some embodiments, the adenosine deaminase comprises an K157X mutation in ecTadA SEQ ID NO: 15, or a corresponding mutation in another adenosine deaminase, where X indicates any amino acid other than the corresponding amino acid in the wild-type adenosine deaminase. In some embodiments, the adenosine deaminase comprises a K157N mutation in SEQ ID NO: 15, or a corresponding mutation in another adenosine deaminase.

In some embodiments, the adenosine deaminase comprises an P48X mutation in ecTadA SEQ ID NO: 15, or a corresponding mutation in another adenosine deaminase, where X indicates any amino acid other than the corresponding amino acid in the wild-type adenosine deaminase. In some embodiments, the adenosine deaminase comprises a P48S, P48T, or P48A mutation in SEQ ID NO: 15, or a corresponding mutation in another adenosine deaminase.

In some embodiments, the adenosine deaminase comprises an A142X mutation in ecTadA SEQ ID NO: 15, or a corresponding mutation in another adenosine deaminase, where X indicates any amino acid other than the corresponding amino acid in the wild-type adenosine deaminase. In some embodiments, the adenosine deaminase comprises a A142N mutation in SEQ ID NO: 15, or a corresponding mutation in another adenosine deaminase.

In some embodiments, the adenosine deaminase comprises an W23X mutation in ecTadA SEQ ID NO: 15, or a corresponding mutation in another adenosine deaminase, where X indicates any amino acid other than the corresponding amino acid in the wild-type adenosine deaminase. In some embodiments, the adenosine deaminase comprises a W23R, or W23L mutation in SEQ ID NO: 15, or a corresponding mutation in another adenosine deaminase.

In some embodiments, the adenosine deaminase comprises an R152X mutation in ecTadA SEQ ID NO: 15, or a corresponding mutation in another adenosine deaminase, where X indicates any amino acid other than the corresponding amino acid in the wild-type adenosine deaminase. In some embodiments, the adenosine deaminase comprises a R152P, or R52H mutation in SEQ ID NO: 15, or a corresponding mutation in another adenosine deaminase.

In some embodiments, the adenosine deaminase comprises the combination of mutations of any of the adenosine deaminases (e.g., ecTadA adenosine deaminases) described herein. For example, the adenosine deaminase may comprise the mutations H36L, R51L, L84F, A106V, D108N, H123Y, S146C, D147Y, E155V, I156F, and K157N (relative to SEQ ID NO: 15) of clone pNMG-477. In some embodiments, the adenosine deaminase comprises the following combination of mutations relative to SEQ ID NO:15, where each mutation of a combination is separated by a "_" and each combination of mutations is between parentheses: (A106V_D108N), (R107C_D108N), (H8Y_D108N_S127S_D147Y_Q154H), (H8Y_R24W_D108N_N127S_D147Y_E155V), (D108N_D147Y_E155V), (H8Y_D108N_S127S), (H8Y_D108N_N127S_D147Y_Q154H), (A106V_D108N_D147Y_E155V), (D108Q_D147Y_E155V), (D108M_D147Y_E155V), (D108L_D147Y_E155V), (D108K_D147Y_E155V), (D108I_D147Y_E155V), (D108F_D147Y_E155V), (A106V_D108N_D147Y), (A106V_D108M_D147Y_E155V), (E59A_A106V_D108N_D147Y_E155V), (E59A cat dead_A106V_D108N_D147Y_E155V), (L84F_A106V_D108N_H123Y_D147Y_E155V_I156Y), (L84F_A106V_D108N_H123Y_D147Y_E155V_I156F), (D103A_D014N), (G22P_D103A_D104N), (G22P_D103A_D104N_S138A), (D103A_D104N_S138A), (R26G_L84F_A106V_R107H_D108N_H123Y_A142N_A143D_D147Y_E155V_I156F), (E25G_R26G_L84F_A106V_R107H_D108N_H123Y_A142N_A143D_D147Y_E155V_I15 6F), (E25D_R26G_L84F_A106V_R107K_D108N_H123Y_A142N_A143G_D147Y_E155V_I156), (R26Q_L84F_A106V_D108N_H123Y_A142N_D147Y_E155V_I156F), (E25M_R26G_L84F_A106V_R107P_D108N_H123Y_A142N_A143D_D147Y_E155V_I15 6F), (R26C_L84F_A106V_R107H_D108N_H123Y_A142N_D147Y_E155V_I156F), (L84F_A106V_D108N_H123Y_A142N_A143L_D147Y_E155V_I156F), (R26G_L84F_A106V_D108N_H123Y_A142N_D147Y_E155V_I156F), (E25A_R26G_L84F_A106V_R107N_D108N_H123Y_A142N_A143E_D147Y_E155V_I15 6F), (R26G_L84F_A106V_R107H_D108N_H123Y_A142N_A143D_D147Y_E155V_I156F), (A106V_D108N_A142N_D147Y_E155V), (R26G_A106V_D108N_A142N_D147Y_E155V), (E25D_R26G_A106V_R107K_D108N_A142N_A143G_D147Y_E155V), (R26G_A106V_D108N_R107H_A142N_A143D_D147Y_E155V), (E25D_R26G_A106V_D108N_A142N_D147Y_E155V), (A106V_R107K_D108N_A142N_D147Y_E155V), (A106V_D108N_A142N_A143G_D147Y_E155V), (A106V_D108N_A142N_A143L_D147Y_E155V), (H36L_R51L_L84F_A106V_D108N_H123Y_S146C_D147Y_E155V_I156F_K157N), (N37T_P48T_M70L_L84F_A106V_D108N_H123Y_D147Y_I49V_E155V_I156F), (N37S_L84F_A106V_D108N_H123Y_D147Y_E155V_I156F_K161T), (H36L_L84F_A106V_D108N_H123Y_D147Y_Q154H_E155V_I156F), (N72S_L84F_A106V_D108N_H123Y_S146R_D147Y_E155V_I156F), (H36L_P48L_L84F_A106V_D108N_H123Y_E134G_D147Y_E155V_I156F), (H36L_L84F_A106V_D108N_H123Y_D147Y_E155V_I156F_K157N), (H36L_L84F_A106V_D108N_H123Y_S146C_D147Y_E155V_I156F), (L84F_A106V_D108N_H123Y_S146R_D147Y_E155V_I156F_K161T), (N37S_R51H_D77G_L84F_A106V_D108N_H123Y_D147Y_E155V_I156F), (R51L_L84F_A106V_D108N_H123Y_D147Y_E155V_I156F_K157N), (D24G_Q71R_L84F_H96L_A106V_D108N_H123Y_D147Y_E155V_I156F_K160E), (H36L_G67V_L84F_A106V_D108N_H123Y_S146T_D147Y_E155V_I156F), (Q71R_L84F_A106V_D108N_H123Y_L137M_A143E_D147Y_E155V_I156F), (E25G_L84F_A106V_D108N_H123Y_D147Y_E155V_I156F_Q159L), (L84F_A91T_F104I_A106V_D108N_H123Y_D147Y_E155V_156F), (N72D_L84F_A106V_D108N_H123Y_G125A_D147Y_E155V_I156F), (P48S_L84F_S97C_A106V_D108N_H123Y_D147Y_E155V_I156F), (W23G_L84F_A106V_D108N_H123Y_D147Y_E155V_I156F), (D24G_P48L_Q71R_L84F_A106V_D108N_H123Y_D147Y_E155V_I156F_Q159L), (L84F_A106V_D108N_H123Y_A142N_D147Y_E155V_I156F), (H36L_R51L_L84F_A106V_D108N_H123Y_A142N_S146C_D147Y_E155V_I156F_K157N), (N37S_L84F_A106V_D108N_H123Y_A142N_D147Y_E155V_I156F_K161T), (L84F_A106V_D108N_D147Y_E155V_I156F), (R51L_L84F_A106V_D108N_H123Y_S146C_D147Y_E155V_I156F_K157N_K161T), (L84F_A106V_D108N_H123Y_S146C_D147Y_E155V_I156F_K161T), (L84F_A106V_D108N_H123Y_S146C_D147Y_E155V_I156F_K157N_K160E_K161T), (L84F_A106V_D108N_H123Y_S146C_D147Y_E155V_I156F_K157N_K160E), (R74Q L84F_A106V_D108N_H123Y_D147Y_E155V_

I156F), (R74A_L84F_A106V_D108N_H123Y_D147Y_E155V_I156F), (L84F_A106V_D108N_H123Y_D147Y_E155V_I156F), (R74Q_L84F_A106V_D108N_H123Y_D147Y_E155V_I156F), (L84F_R98Q_A106V_D108N_H123Y_D147Y_E155V_I156F), (L84F_A106V_D108N_H123Y_R129Q_D147Y_E155V_I156F), (P48S_L84F_A106V_D108N_H123Y_A142N_D147Y_E155V_I156F), (P48S_A142N), (P48T_I49V_L84F_A106V_D108N_H123Y_A142N_D147Y_E155V_I156F_L157N), (P48T_I49V_A142N), (H36L_P48S_R51L_L84F_A106V_D108N_H123Y_S146C_D147Y_E155V_I156F_K157N), (H36L_P48S_R51L_L84F_A106V_D108N_H123Y_S146C_A142N_D147Y_E155V156F_K157N), (H36L_P48T_I49V_R51L_L84F_A106V_D108N_H123Y_S146C_D147Y_E155V_I156F_K157N), (H36L_P48T_I49V_R51L_L84F_A106V_D108N_H123Y_A142N_S146C_D147Y_E155V_I156F_K157N), (H36L_P48A_R51L_L84F_A106V_D108N_H123Y_S146C_D147Y_E155V_I156F_K157N), (H36L_P48A_R51L_L84F_A106V_D108N_H123Y_A142N_S146C_D147Y_E155V_I156F_K157N), (H36L_P48A_R51L_L84F_A106V_D108N_H123Y_S146C_A142N_D147Y_E155V_I156F_K157N), (W23L_H36L_P48A_R51L_L84F_A106V_D108N_H123Y_S146C_D147Y_E155V_I156F_K157N), (W23R_H36L_P48A_R51L_L84F_A106V_D108N_H123Y_S146C_D147Y_E155V_I156F_K157N), (W23L_H36L_P48A_R51L_L84F_A106V_D108N_H123Y_S146R_D147Y_E155V_I156F_K161T), (H36L_P48A_R51L_L84F_A106V_D108N_H123Y_S146C_D147Y_R152H_E155V_I156F_K157N), (H36L_P48A_R51L_L84F_A106V_D108N_H123Y_S146C_D147Y_R152P_E155V_I156F_K157N), (W23L_H36L_P48A_R51L_L84F_A106V_D108N_H123Y_S146C_D147Y_R152P_E155V_I156F_K157N), (W23L_H36L_P48A_R51L_L84F_A106V_D108N_H123Y_A142A_S146C_D147Y_E155V_I156F_K157N), (W23L_H36L_P48A_R51L_L84F_A106V_D108N_H123Y_A142A_S146C_D147Y_R152P_E155V_I156F_K157N), (W23L_H36L_P48A_R51L_L84F_A106V_D108N_H123Y_S146R_D147Y_E155V_I156F_K161T), (W23R_H36L_P48A_R51L_L84F_A106V_D108N_H123Y_S146C_D147Y_R152P_E155V _I156F_K157N), (H36L_P48A_R51L_L84F_A106V_D108N_H123Y_A142N_S146C_D147Y_R152P_E155V_I156F_K157N).

In some embodiments, the adenosine deaminase comprises an amino acid sequence that is at least 60%, 65%, 70%, 75%, 80%, 85%, 90%, 95, 98%, 99%, or 99.5% identical to any one of SEQ ID NOs: 15-23, or any of the adenosine deaminases provided herein. In some embodiments, the adenosine deaminase comprises an amino acid sequence that has 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50 or more mutations compared to any one of the amino acid sequences set forth in SEQ ID NO: 15 or any of the adenosine deaminases provided herein. In some embodiments, the adenosine deaminase comprises an amino acid sequence that has at least 5, at least 10, at least 15, at least 20, at least 25, at least 30, at least 35, at least 40, at least 45, at least 50, at least 60, at least 70, at least 80, at least 90, at least 100, at least 110, at least 120, at least 130, at least 140, at least 150, at least 160, or at least 166, identical contiguous amino acid residues as compared to any one of the amino acid sequences set forth in SEQ ID NO: 15 or any of the adenosine deaminases provided herein. In some embodiments, the adenosine deaminase comprises the amino acid sequence of SEQ ID NO: 15 or any of the adenosine deaminases provided herein. In some embodiments, the adenosine deaminase consists of the amino acid sequence of SEQ ID NO: 15 or any of the adenosine deaminases provided herein.

Nuclear Localization Signals

In various embodiments, the base editors disclosed herein further comprise one or more, preferably at least two nuclear localization signals. In a preferred embodiment, the base editors comprise at least two NLSs. In embodiments with at least two NLSs, the NLSs can be the same NLSs or they can be different NLSs. In addition, the NLSs may be expressed as part of a fusion protein with the remaining portions of the base editors. The location of the NLS fusion can be at the N-terminus, the C-terminus, or within a sequence of a base editor (e.g., inserted between the encoded napR/DNAbp component (e.g., Cas9) and a DNA effector moiety (e.g., a deaminase)).

The NLSs may be any known NLS sequence in the art. The NLSs may also be any future-discovered NLSs for nuclear localization. The NLSs also may be any naturally-occurring NLS, or any non-naturally occurring NLS (e.g., an NLS with one or more desired mutations).

A nuclear localization signal or sequence (NLS) is an amino acid sequence that tags, designates, or otherwise marks a protein for import into the cell nucleus by nuclear transport. Typically, this signal consists of one or more short sequences of positively charged lysines or arginines exposed on the protein surface. Different nuclear localized proteins may share the same NLS. An NLS has the opposite function of a nuclear export signal (NES), which targets proteins out of the nucleus. A nuclear localization signal can also target the exterior surface of a cell. Thus, a single nuclear localization signal can direct the entity with which it is associated to the exterior of a cell and to the nucleus of a cell. Such sequences can be of any size and composition, for example more than 25, 25, 15, 12, 10, 8, 7, 6, 5 or 4 amino acids, but will preferably comprise at least a four to eight amino acid sequence known to function as a nuclear localization signal (NLS).

The term "nuclear localization sequence" or "NLS" refers to an amino acid sequence that promotes import of a protein into the cell nucleus, for example, by nuclear transport. Nuclear localization sequences are known in the art and would be apparent to the skilled artisan. For example, NLS sequences are described in Plank et al., international PCT application, PCT/EP2000/011690, filed Nov. 23, 2000, published as WO/2001/038547 on May 31, 2001, the contents of which are incorporated herein by reference for their disclosure of exemplary nuclear localization sequences. In some embodiments, a NLS comprises the amino acid sequence PKKKRKV (SEQ ID NO: 115), MDSLLMNRRKFLY-QFKNVRWAKGRRETYLC (SEQ ID NO: 116), KRTADGSEFESPKKKRKV (SEQ ID NO: 1), or KRTADGSEFEPKKKRKV (SEQ ID NO: 2).

In one aspect of the invention, a base editor (e.g., a known base editor, such as BE1, BE2, BE3, or BE4) may be modified with one or more nuclear localization signals (NLS), preferably at least two NLSs. In preferred embodiments, the base editors are modified with two or more NLSs. The invention contemplates the use of any nuclear localization signal known in the art at the time of the invention, or any nuclear localization signal that is identified or otherwise made available in the state of the art after the time of the instant filing. A representative nuclear localization signal is a peptide sequence that directs the protein to the nucleus of the cell in which the sequence is expressed. A nuclear localization signal is predominantly basic, can be positioned almost anywhere in a protein's amino acid sequence, generally comprises a short sequence of four amino acids (Autieri & Agrawal, (1998) J. Biol. Chem. 273: 14731-37, incorporated herein by reference) to eight amino acids, and is typically rich in lysine and arginine residues (Magin et al., (2000) Virology 274: 11-16, incorporated herein by reference). Nuclear localization signals often comprise proline residues. A variety of nuclear localization signals have been identified and have been used to effect transport of biological molecules from the cytoplasm to the nucleus of a cell. See, e.g., Tinland et al., (1992) Proc. Natl. Acad. Sci. U.S.A. 89:7442-46; Moede et al., (1999) FEBS Leff. 461:229-34, which is incorporated by reference. Translocation is currently thought to involve nuclear pore proteins.

Most NLSs can be classified in three general groups: (i) a monopartite NLS exemplified by the SV40 large T antigen NLS (PKKKRKV SEQ ID NO: 115); (ii) a bipartite motif consisting of two basic domains separated by a variable number of spacer amino acids and exemplified by the *Xenopus* nucleoplasmin NLS (KRXXXXXXXXXXKKKL SEQ ID NO: 119); and (iii) noncanonical sequences such as M9 of the hnRNP A1 protein, the influenza virus nucleoprotein NLS, and the yeast Gal4 protein NLS (Dingwall and Laskey 1991).

Nuclear localization signals appear at various points in the amino acid sequences of proteins. NLS's have been identified at the N-terminus, the C-terminus and in the central region of proteins. Thus, the specification provides base editors that may be modified with one or more NLSs at the C-terminus, the N-terminus, as well as at in internal region of the base editor. The residues of a longer sequence that do not function as component NLS residues should be selected so as not to interfere, for example tonically or sterically, with the nuclear localization signal itself. Therefore, although there are no strict limits on the composition of an NLS-comprising sequence, in practice, such a sequence can be functionally limited in length and composition.

The present disclosure contemplates any suitable means by which to modify a base editor to include one or more NLSs. In one aspect, the base editors can be engineered to express a base editor protein that is translationally fused at its N-terminus or its C-terminus (or both) to one or more NLSs, i.e., to form a base editor-NLS fusion construct. In other embodiments, the base editor-encoding nucleotide sequence can be genetically modified to incorporate a reading frame that encodes one or more NLSs in an internal region of the encoded base editor. In addition, the NLSs may include various amino acid linkers or spacer regions encoded between the base editor and the N-terminally, C-terminally, or internally-attached NLS amino acid sequence, e.g., and in the central region of proteins. Thus, the present disclosure also provides for nucleotide constructs, vectors, and host cells for expressing fusion proteins that comprise a base editor and one or more NLSs.

The improved base editors described herein may also comprise nuclear localization signals which are linked to a base editor through one or more linkers, e.g., and polymeric, amino acid, nucleic acid, polysaccharide, chemical, or nucleic acid linker element. The linkers within the contemplated scope of the disclosure are not intended to have any limitations and can be any suitable type of molecule (e.g., polymer, amino acid, polysaccharide, nucleic acid, lipid, or any synthetic chemical linker moiety) and be joined to the base editor by any suitable strategy that effectuates forming a bond (e.g., covalent linkage, hydrogen bonding) between the base editor and the one or more NLSs.

Additional Functionalities

The improved base editors described herein also may include one or more additional functionalities. In certain embodiments, the additional functionalities may include an effector of base repair.

In certain embodiments, the base editors described herein may comprise an inhibitor of base repair. The term "inhibitor of base repair" or "IBR" refers to a protein that is capable in inhibiting the activity of a nucleic acid repair enzyme, for example a base excision repair enzyme. In some embodiments, the IBR is an inhibitor of inosine base excision repair. Exemplary inhibitors of base repair include inhibitors of APE1, Endo III, Endo IV, Endo V, Endo VIII, Fpg, hOGG1, hNEIL1, T7 EndoI, T4PDG, UDG, hSMUG1, and hAAG. In some embodiments, the IBR is an inhibitor of Endo V or hAAG. In some embodiments, the IBR is a catalytically inactive EndoV or a catalytically inactive hAAG.

In other embodiments, the base editors described herein may comprise a uracil glycosylase inhibitor. The term "uracil glycosylase inhibitor" or "UGI," as used herein, refers to a protein that is capable of inhibiting a uracil-DNA glycosylase base-excision repair enzyme. In some embodiments, a UGI domain comprises a wild-type UGI or a UGI as set forth in SEQ ID NO: 10. In some embodiments, the UGI proteins provided herein include fragments of UGI and proteins homologous to a UGI or a UGI fragment. For example, in some embodiments, a UGI domain comprises a fragment of the amino acid sequence set forth in SEQ ID NO: 10. In some embodiments, a UGI fragment comprises an amino acid sequence that comprises at least 60%, at least 65%, at least 70%, at least 75%, at least 80%, at least 85%, at least 90%, at least 95%, at least 96%, at least 97%, at least 98%, at least 99%, or at least 99.5% of the amino acid sequence as set forth in SEQ ID NO: 10. In some embodiments, a UGI comprises an amino acid sequence homologous to the amino acid sequence set forth in SEQ ID NO: 10, or an amino acid sequence homologous to a fragment of the amino acid sequence set forth in SEQ ID NO: 10. In some embodiments, proteins comprising UGI or fragments of UGI or homologs of UGI or UGI fragments are referred to as "UGI variants." A UGI variant shares homology to UGI, or a fragment thereof. For example a UGI variant is at least 70% identical, at least 75% identical, at least 80% identical, at least 85% identical, at least 90% identical, at least 95% identical, at least 96% identical, at least 97% identical, at least 98% identical, at least 99% identical, at least 99.5% identical, or at least 99.9% identical to a wild type UGI or a UGI as set forth in SEQ ID NO: 10. In some embodiments, the UGI variant comprises a fragment of UGI, such that the fragment is at least 70% identical, at least 80% identical, at least 90% identical, at least 95% identical, at least 96% identical, at least 97% identical, at least 98% identical, at least 99% identical, at least 99.5% identical, or at least 99.9% to the corresponding fragment of wild-type UGI or a UGI as set forth in SEQ ID NO: 10. In some embodiments, the UGI comprises the following amino acid sequence:

>sp|P14739|UNGI_BPPB2 Uracil-DNA glycosylase inhibitor (SEQ ID NO: 10)
MTNLSDIIEKETGKQLVIQESILMLPEEVEEVIGNKPESDILVHTAYDE
STDENVMLLTSDAPEYKPWALVIQDSNGENKIKML.

In some embodiments, the base editor described herein may comprise one or more heterologous protein domains (e.g., about or more than about 1, 2, 3, 4, 5, 6, 7, 8, 9, 10, or more domains in addition to the base editor components). A base editor may comprise any additional protein sequence, and optionally a linker sequence between any two domains. Examples of protein domains that may be fused to a base editor or component thereof (e.g., the napR/DNAbp moiety, the nucleic acid effector moiety, or the NLS moeity) include, without limitation, epitope tags, reporter gene sequences, and protein domains having one or more of the following activities: methylase activity, demethylase activity, transcription activation activity, transcription repression activity, transcription release factor activity, histone modification activity, RNA cleavage activity and nucleic acid binding activity. Non-limiting examples of epitope tags include histidine (His) tags, V5 tags, FLAG tags, influenza hemagglutinin (HA) tags, Myc tags, VSV-G tags, and thioredoxin (Trx) tags. Examples of reporter genes include, but are not limited to, glutathione-5-transferase (GST), horseradish peroxidase (HRP), chloramphenicol acetyltransferase (CAT) beta-galactosidase, beta-glucuronidase, luciferase, green fluorescent protein (GFP), HcRed, DsRed, cyan fluorescent protein (CFP), yellow fluorescent protein (YFP), and autofluorescent proteins including blue fluorescent protein (BFP). A base editor may be fused to a gene sequence encoding a protein or a fragment of a protein that bind DNA molecules or bind other cellular molecules, including but not limited to maltose binding protein (MBP), S-tag, Lex A DNA binding domain (DBD) fusions, GAL4 DNA binding domain fusions, and herpes simplex virus (HSV) BP16 protein fusions. Additional domains that may form part of a fusion protein comprising a base editor are described in US20110059502, incorporated herein by reference. In some embodiments, a tagged base editor is used to identify the location of a target sequence.

In an aspect of the invention, a reporter gene which includes but is not limited to glutathione-5-transferase (GST), horseradish peroxidase (HRP), chloramphenicol acetyltransferase (CAT) beta-galactosidase, beta-glucuronidase, luciferase, green fluorescent protein (GFP), HcRed, DsRed, cyan fluorescent protein (CFP), yellow fluorescent protein (YFP), and autofluorescent proteins including blue fluorescent protein (BFP), may be introduced into a cell to encode a gene product which serves as a marker by which to measure the alteration or modification of expression of the gene product. In a further embodiment of the invention, the DNA molecule encoding the gene product may be introduced into the cell via a vector. In a preferred embodiment of the invention the gene product is luciferase. In a further embodiment of the invention the expression of the gene product is decreased.

Other exemplary features that may be present are localization sequences, such as cytoplasmic localization sequences, export sequences, such as nuclear export sequences, or other localization sequences, as well as sequence tags that are useful for solubilization, purification, or detection of the fusion proteins. Suitable protein tags provided herein include, but are not limited to, biotin carboxylase carrier protein (BCCP) tags, myc-tags, calmodulin-tags, FLAG-tags, hemagglutinin (HA)-tags, polyhistidine tags, also referred to as histidine tags or His-tags, maltose binding protein (MBP)-tags, nus-tags, glutathione-S-transferase (GST)-tags, green fluorescent protein (GFP)-tags, thioredoxin-tags, S-tags, Softags (e.g., Softag 1, Softag 3), strep-tags, biotin ligase tags, FlAsH tags, V5 tags, and SBP-tags. Additional suitable sequences will be apparent to those of skill in the art. In some embodiments, the fusion protein comprises one or more His tags.

The Guide Sequence (e.g., a Guide RNA)

In various embodiments, the improved base editors can be complexed, bound, or otherwise associated with (e.g., via any type of covalent or non-covalent bond) one or more guide sequences, i.e., the sequence which becomes associated or bound to the base editor and directs its localization to a specific target sequence having complementarity to the guide sequence or a portion thereof. The particular design aspects of a guide sequence will depend upon the nucleotide sequence of a genomic target site of interest (i.e., the desired site to be edited) and the type of napR/DNAbp (e.g., type of Cas protein) present in the base editor, among other factors, such as PAM sequence locations, percent G/C content in the target sequence, the degree of microhomology regions, secondary structures, etc.

In general, a guide sequence is any polynucleotide sequence having sufficient complementarity with a target polynucleotide sequence to hybridize with the target sequence and direct sequence-specific binding of a napR/DNAbp (e.g., a Cas9, Cas9 homolog, or Cas9 variant) to the target sequence. In some embodiments, the degree of complementarity between a guide sequence and its corresponding target sequence, when optimally aligned using a suitable alignment algorithm, is about or more than about 50%, 60%, 75%, 80%, 85%, 90%, 95%, 97.5%, 99%, or more. Optimal alignment may be determined with the use of any suitable algorithm for aligning sequences, non-limiting example of which include the Smith-Waterman algorithm, the Needleman-Wunsch algorithm, algorithms based on the Burrows-Wheeler Transform (e.g. the Burrows Wheeler Aligner), ClustalW, Clustal X, BLAT, Novoalign (Novocraft Technologies, ELAND (Illumina, San Diego, Calif.), SOAP (available at soap.genomics.org.cn), and Maq (available at maq.sourceforge.net). In some embodiments, a guide sequence is about or more than about 5, 10, 11, 12, 13, 14, 15, 16, 17, 18, 19, 20, 21, 22, 23, 24, 25, 26, 27, 28, 29, 30, 35, 40, 45, 50, 75, or more nucleotides in length.

In some embodiments, a guide sequence is less than about 75, 50, 45, 40, 35, 30, 25, 20, 15, 12, or fewer nucleotides in length. The ability of a guide sequence to direct sequence-specific binding of a base editor to a target sequence may be assessed by any suitable assay. For example, the components of a base editor, including the guide sequence to be tested, may be provided to a host cell having the corresponding target sequence, such as by transfection with vectors encoding the components of a base editor disclosed herein, followed by an assessment of preferential cleavage within the target sequence, such as by Surveyor assay as described herein. Similarly, cleavage of a target polynucleotide sequence may be evaluated in a test tube by providing the target sequence, components of a base editor, including the guide sequence to be tested and a control guide sequence different from the test guide sequence, and comparing binding or rate of cleavage at the target sequence between the test and control guide sequence reactions. Other assays are possible, and will occur to those skilled in the art.

A guide sequence may be selected to target any target sequence. In some embodiments, the target sequence is a sequence within a genome of a cell. Exemplary target sequences include those that are unique in the target genome. For example, for the *S. pyogenes* Cas9, a unique target sequence in a genome may include a Cas9 target site of the form

MMMMMMMMNNNNNNNNNNNNNXGG (SEQ ID NO: 121)

where

NNNNNNNNNNNNNXGG (SEQ ID NO: 122)

(N is A, G, T, or C; and X can be anything) has a single occurrence in the genome. A unique target sequence in a genome may include an *S. pyogenes* Cas9 target site of the form

MMMMMMMMNNNNNNNNNNNNNXGG (SEQ ID NO: 123)

where

NNNNNNNNNNNNNXGG (SEQ ID NO: 124)

(N is A, G, T, or C; and X can be anything) has a single occurrence in the genome. For the *S. thermophilus* CRISPR1Cas9, a unique target sequence in a genome may include a Cas9 target site of the form

MMMMMMMMNNNNNNNNNNNNNXXAGAAW (SEQ ID NO: 125)

where

NNNNNNNNNNNNNXXAGAAW (SEQ ID NO: 126)

(N is A, G, T, or C; X can be anything; and W is A or T) has a single occurrence in the genome. A unique target sequence in a genome may include an *S. thermophilus* CRISPR 1 Cas9 target site of the form

MMMMMMMMNNNNNNNNNNNNNXXAGAAW (SEQ ID NO: 127)

where

NNNNNNNNNNNNNXXAGAAW (SEQ ID NO: 128)

(N is A, G, T, or C; X can be anything; and W is A or T) has a single occurrence in the genome. For the *S. pyogenes* Cas9, a unique target sequence in a genome may include a Cas9 target site of the form

MMMMMMMMNNNNNNNNNNNNNXGGXG (SEQ ID NO: 129)

where

NNNNNNNNNNNNNXGGXG (SEQ ID NO: 130)

(N is A, G, T, or C; and X can be anything) has a single occurrence in the genome. A unique target sequence in a genome may include an *S. pyogenes* Cas9 target site of the form

MMMMMMMMNNNNNNNNNNNNNXGGXG (SEQ ID NO: 131)

where

NNNNNNNNNNNNNXGGXG (SEQ ID NO: 132)

(N is A, G, T, or C; and X can be anything) has a single occurrence in the genome. In each of these sequences "M" may be A, G, T, or C, and need not be considered in identifying a sequence as unique.

In some embodiments, a guide sequence is selected to reduce the degree of secondary structure within the guide sequence. Secondary structure may be determined by any suitable polynucleotide folding algorithm. Some programs are based on calculating the minimal Gibbs free energy. An example of one such algorithm is mFold, as described by Zuker and Stiegler (Nucleic Acids Res. 9 (1981), 133-148). Another example folding algorithm is the online webserver RNAfold, developed at Institute for Theoretical Chemistry at the University of Vienna, using the centroid structure prediction algorithm (see e.g. A. R. Gruber et al., 2008, *Cell* 106(1): 23-24; and P A Carr and G M Church, 2009, *Nature Biotechnology* 27(12): 1151-62). Further algorithms may be found in U.S. application Ser. No. 61/836,080; Broad Reference BI-2013/004A); incorporated herein by reference.

In general, a tracr mate sequence includes any sequence that has sufficient complementarity with a tracr sequence to promote one or more of: (1) excision of a guide sequence flanked by tracr mate sequences in a cell containing the corresponding tracr sequence; and (2) formation of a complex at a target sequence, wherein the complex comprises the tracr mate sequence hybridized to the tracr sequence. In general, degree of complementarity is with reference to the optimal alignment of the tracr mate sequence and tracr sequence, along the length of the shorter of the two sequences. Optimal alignment may be determined by any suitable alignment algorithm, and may further account for secondary structures, such as self-complementarity within either the tracr sequence or tracr mate sequence. In some embodiments, the degree of complementarity between the tracr sequence and tracr mate sequence along the length of the shorter of the two when optimally aligned is about or more than about 25%, 30%, 40%, 50%, 60%, 70%, 80%, 90%, 95%, 97.5%, 99%, or higher. In some embodiments, the tracr sequence is about or more than about 5, 6, 7, 8, 9, 10, 11, 12, 13, 14, 15, 16, 17, 18, 19, 20, 25, 30, 40, 50, or more nucleotides in length. In some embodiments, the tracr sequence and tracr mate sequence are contained within a single transcript, such that hybridization between the two produces a transcript having a secondary structure, such as a hairpin. Preferred loop forming sequences for use in hairpin structures are four nucleotides in length, and most preferably have the sequence GAAA. However, longer or shorter loop sequences may be used, as may alternative sequences. The sequences preferably include a nucleotide triplet (for example, AAA), and an additional nucleotide (for example C or G). Examples of loop forming sequences include CAAA and AAAG. In an embodiment of the invention, the transcript or transcribed polynucleotide sequence has at least two or more hairpins. In preferred embodiments, the transcript has two, three, four or five hairpins. In a further embodiment of the invention, the transcript has at most five hairpins. In some embodiments, the single transcript further includes a transcription termination sequence; preferably this is a polyT sequence, for example six T nucleotides. Further non-limiting examples of single polynucleotides comprising a guide sequence, a tracr mate sequence, and a tracr sequence are as follows (listed 5' to 3'), where "N" represents a base of a guide sequence, the first block of lower case letters represent the tracr mate sequence, and the second block of lower case letters represent the tracr sequence, and the final poly-T sequence represents the transcription terminator: (1)

(1)
(SEQ ID NO: 133)
NNNNNNNNgttttttgtactctcaagatttaGAAAtaaatcttgcagaag
ctacaaagataaggcttcatgccgaaatcaacaccctgtcattttatgg
cagggtgttttcgttatttaaTTTTTT;

(2)
(SEQ ID NO: 134)
NNNNNNNNNNNNNNNNNNNgttttttgtactctcaGAAAtgcagaagctac
aaagataaggcttcatgccgaaatcaacaccctgtcattttatggcagg
gtgttttcgttatttaaTTTTTT;

(3)
(SEQ ID NO: 135)
NNNNNNNNNNNNNNNNNNNNgttttttgtactctcaGAAAtgcagaagct
acaaagataaggcttcatgccgaaatca acaccctgtcattttatggc
agggtgtTTTTT;

(4)
(SEQ ID NO: 136)
NNNNNNNNNNNNNNNNNNNNgttttagagctaGAAAtagcaagttaaaa
taaggctagtccgttatcaacttgaaaa agtggcaccgagtcggtgcT
TTTTT;

(5)
(SEQ ID NO: 137)
NNNNNNNNNNNNNNNNNNNNgttttagagctaGAAATAGcaagttaaaa
taaggctagtccgttatcaacttgaa aaagtgTTTTTTT; and (6)
(SEQ ID NO: 138)
NNNNNNNNNNNNNNNNNNNNgttttagagctagAAATAGcaagttaaaa
taaggctagtccgttatcaTTTTT TTT.

In some embodiments, sequences (1) to (3) are used in combination with Cas9 from S. thermophilus CRISPR1. In some embodiments, sequences (4) to (6) are used in combination with Cas9 from S. pyogenes. In some embodiments, the tracr sequence is a separate transcript from a transcript comprising the tracr mate sequence.

It will be apparent to those of skill in the art that in order to target any of the fusion proteins comprising a Cas9 domain and an adenosine deaminase, as disclosed herein, to a target site, e.g., a site comprising a point mutation to be edited, it is typically necessary to co-express the fusion protein together with a guide RNA, e.g., an sgRNA. As explained in more detail elsewhere herein, a guide RNA typically comprises a tracrRNA framework allowing for Cas9 binding, and a guide sequence, which confers sequence specificity to the Cas9:nucleic acid editing enzyme/domain fusion protein.

In some embodiments, the guide RNA comprises a structure 5'-[guide sequence]-guuuuagagcua-gaaauagcaaguuaaaauaaaggcuaguccguuaucaac-uugaaaaaguggcaccgagucggugcuu uuu-3' (SEQ ID NO: 139), wherein the guide sequence comprises a sequence that is complementary to the target sequence. The guide sequence is typically 20 nucleotides long. The sequences of suitable guide RNAs for targeting Cas9:nucleic acid editing enzyme/domain fusion proteins to specific genomic target sites will be apparent to those of skill in the art based on the instant disclosure. Such suitable guide RNA sequences typically comprise guide sequences that are complementary to a nucleic sequence within 50 nucleotides upstream or downstream of the target nucleotide to be edited. Some exemplary guide RNA sequences suitable for targeting any of the provided fusion proteins to specific target sequences are provided herein. Additional guide sequences are well known in the art and can be used with the base editors described herein.

Linkers

In certain embodiments, linkers may be used to link any of the peptides or peptide domains or moieties of the invention (e.g., moiety A covalently linked to moiety B which is covalently linked to moiety C).

As defined above, the term "linker," as used herein, refers to a chemical group or a molecule linking two molecules or moieties, e.g., a binding domain and a cleavage domain of a nuclease. In some embodiments, a linker joins a gRNA binding domain of an RNA-programmable nuclease and the catalytic domain of a recombinase. In some embodiments, a linker joins a dCas9 and base editor moiety (e.g., a cytidine or adenosine deaminase). Typically, the linker is positioned between, or flanked by, two groups, molecules, or other moieties and connected to each one via a covalent bond, thus connecting the two. In some embodiments, the linker is an amino acid or a plurality of amino acids (e.g., a peptide or protein). In some embodiments, the linker is an organic molecule, group, polymer, or chemical moiety. In some embodiments, the linker is 5-100 amino acids in length, for example, 5, 6, 7, 8, 9, 10, 11, 12, 13, 14, 15, 16, 17, 18, 19, 20, 21, 22, 23, 24, 25, 26, 27, 28, 29, 30, 30-35, 35-40, 40-45, 45-50, 50-60, 60-70, 70-80, 80-90, 90-100, 100-150, or 150-200 amino acids in length. Longer or shorter linkers are also contemplated The linker may be as simple as a covalent bond, or it may be a polymeric linker many atoms in length. In certain embodiments, the linker is a polypeptide or based on amino acids. In other embodiments, the linker is not peptide-like. In certain embodiments, the linker is a covalent bond (e.g., a carbon-carbon bond, disulfide bond, carbon-heteroatom bond, etc.). In certain embodiments, the linker is a carbon-nitrogen bond of an amide linkage. In certain embodiments, the linker is a cyclic or acyclic, substituted or unsubstituted, branched or unbranched aliphatic or heteroaliphatic linker. In certain embodiments, the linker is polymeric (e.g., polyethylene, polyethylene glycol, polyamide, polyester, etc.). In certain embodiments, the linker comprises a monomer, dimer, or polymer of aminoalkanoic acid. In certain embodiments, the linker comprises an aminoalkanoic acid (e.g., glycine, ethanoic acid, alanine, beta-alanine, 3-aminopropanoic acid, 4-aminobutanoic acid, 5-pentanoic acid, etc.).

In certain embodiments, the linker comprises a monomer, dimer, or polymer of aminohexanoic acid (Ahx). In certain embodiments, the linker is based on a carbocyclic moiety (e.g., cyclopentane, cyclohexane). In other embodiments, the linker comprises a polyethylene glycol moiety (PEG). In other embodiments, the linker comprises amino acids. In certain embodiments, the linker comprises a peptide. In certain embodiments, the linker comprises an aryl or heteroaryl moiety. In certain embodiments, the linker is based on a phenyl ring. The linker may included functionalized moieties to facilitate attachment of a nucleophile (e.g., thiol, amino) from the peptide to the linker. Any electrophile may be used as part of the linker. Exemplary electrophiles include, but are not limited to, activated esters, activated amides, Michael acceptors, alkyl halides, aryl halides, acyl halides, and isothiocyanates.

In some other embodiments, the linker comprises the amino acid sequence (GGGGS)n (SEQ ID NO: 110), (G)n (SEQ ID NO: 118), (EAAAK)n (SEQ ID NO: 111), (GGS)n (SEQ ID NO: 112), (SGGS)n (SEQ ID NO: 113), SGSETPGTSESATPES SEQ ID NO: 114), (XP)n (SEQ ID NO: 120), or any combination thereof, wherein n is independently an integer between 1 and 30, and wherein X is any amino acid. In some embodiments, the linker comprises the amino acid sequence (GGS)$_n$ (SEQ ID NO: 112), wherein n is 1, 3, or 7. In some embodiments, the linker comprises the amino acid sequence SGSETPGTSESATPES (SEQ ID NO: 114).

In some embodiments, the fusion protein comprises the structure [nucleic acid editing domain]-[optional linker sequence]-[dCas9 or Cas9 nickase]-[optional linker sequence]-[UGI]. In some embodiments, the fusion protein comprises the structure [nucleic acid editing domain]-[optional linker sequence]-[UGI]-[optional linker sequence]-[dCas9 or Cas9 nickase]; [UGI]-[optional linker sequence]-[nucleic acid editing domain]-[optional linker sequence]-[dCas9 or Cas9 nickase]; [UGI]-[optional linker sequence]-[dCas9 or Cas9 nickase]-[optional linker sequence]-[nucleic acid editing domain]; [dCas9 or Cas9 nickase]-[optional linker sequence]-[UGI]-[optional linker sequence]-[nucleic acid editing domain]; or [dCas9 or Cas9 nickase]-[optional linker sequence]-[nucleic acid editing domain]-[optional linker sequence]-[UGI].

Improved Editing Efficiencies

As exemplified in the Examples, the efficiency of base editing may be increased by the various approaches described herein for improving base editors in cells. In one aspect, base editing efficiency may be increased by optimizing base editor codon usage which increases base editor mRNA expression levels thereby increase base editing efficiencies. In another aspect, base editing efficiency may be increased by optimizing base editor amino acid sequences through ancestral sequence reconstruction. In still other aspects, base editing efficiency may be increased by modifying base editors to include at least two NLSs, e.g., wherein one is located at the N-terminus and another (same or difference NLS) is located as the C-terminus of a base editor fusion protein. The level or degree of increase in efficiency may be measured or expressed in any suitable manner such as the percentage of nucleotides correctly edited from the total number of nucleotides attempted to be edited by a base editor described herein.

The base editors in various embodiment may be characterized with an improved editing capability that is at least 0.5-fold, or at least 0.6-fold, or at least 0.7-fold, or at least 0.8-fold, or at least 0.9-fold, or at least 1.0-fold, or at least 1.5-fold, or at least 2.0-fold, or at least 3.0-fold, or at least 4.0-fold, or at least 5.0-fold, or at least 6.0-fold, or at least 7.0-fold, or at least 8.0-fold, or at least 9.0-fold, or at least 10.0-fold, or at least 20-, 30-, 40-, 50-, 60-, 70-, 80-, 90-, or 100-fold or more higher than the base editing efficiency of a base editor that has not been modified by at least one of the modification approached described herein (e.g., codon optimization, at least 2 NLSs, or by ancestral sequence reconstruction. Examples of specific increases in base editing efficiencies are exemplified in the Examples.

II. Methods for Making the Improved Base-Editors

Despite recent advances in the design of base editors, the efficiency of base editing varies widely. To increase base editing efficiency, the inventors sought to identify the factors that limit base editing efficiency in cells. It was surprisingly found by the inventors that expression and nuclear localization in human cells imposed key bottlenecks on editing efficiency. The inventors discovered that by optimizing codon usage, using improved nuclear localization sequences (NLSs), and performing ancestral reconstruction of deaminases resulted in base editors with greatly increased editing efficiency, often more than doubling target nucleotide conversion yields as compared to the unmodified counterpart editors. The resulting base editors were shown, as demonstrated in the Examples, to install point mutations relevant to human disease in a variety of mammalian cell types much more efficiently than previously described base editors. These methods can be used to provide improved base editors that can be used to efficiently edit a nucleic acid molecule in a manner that is dramatically improved as compared to base editors known in the art. The improved base editors may be used to efficiently edit nucleic acid molecules, e.g., a genome, for example, by correcting a disease-causing point mutation.

Thus, the invention relates in various aspects to methods of making the disclosed improved base editors by various modes of manipulation that include but are not limited to codon optimization and performance of ancestral reconstruction of components of the base editors (e.g., of a deaminase) to achieve greater expression levels in a cell, and the use of nuclear localization sequences (NLS)s, preferably at least two NLSs to increase the localization of the expressed base editors into a cell nucleus.

Increasing Expression

The base editors contemplated herein can include modifications that result in increased expression through codon optimization and ancestral reconstruction analysis.

In some embodiments, the base editors (or a component thereof) is codon optimized for expression in particular cells, such as eukaryotic cells. The eukaryotic cells may be those of or derived from a particular organism, such as a mammal, including but not limited to human, mouse, rat, rabbit, dog, or non-human primate. In general, codon optimization refers to a process of modifying a nucleic acid sequence for enhanced expression in the host cells of interest by replacing at least one codon (e.g. about or more than about 1, 2, 3, 4, 5, 10, 15, 20, 25, 50, or more codons) of the native sequence with codons that are more frequently or most frequently used in the genes of that host cell while maintaining the native amino acid sequence. Various species exhibit particular bias for certain codons of a particular amino acid. Codon bias (differences in codon usage between organisms) often correlates with the efficiency of translation of messenger RNA (mRNA), which is in turn believed to be dependent on, among other things, the properties of the codons being translated and the availability of particular transfer RNA (tRNA) molecules. The predominance of selected tRNAs in a cell is generally a reflection of the codons used most frequently in peptide synthesis. Accordingly, genes can be tailored for optimal gene expression in a given organism based on codon optimization. Codon usage tables are readily available, for example, at the "Codon Usage Database", and these tables can be adapted in a number of ways. See Nakamura, Y., et al. "Codon usage tabulated from the international DNA sequence databases: status for the year 2000" Nucl. Acids Res. 28:292 (2000). Computer algorithms for codon optimizing a particular sequence for expression in a particular host cell are also available, such as Gene Forge (Aptagen; Jacobus, Pa.), are also available. In some embodiments, one or more codons (e.g. 1, 2, 3, 4, 5, 10, 15, 20, 25, 50, or more, or all codons) in a sequence encoding a CRISPR enzyme correspond to the most frequently used codon for a particular amino acid.

In other embodiments, the base editors of the invention have improved expression (as compared to non-modified or state of the art counterpart editors) as a result of ancestral sequence reconstruction analysis. Ancestral sequence reconstruction (ASR) is the process of analyzing modern sequences within an evolutionary/phylogenetic context to infer the ancestral sequences at particular nodes of a tree. These ancient sequences are most often then synthesized, recombinantly expressed in laboratory microorganisms or cell lines, and then characterized to reveal the ancient properties of the extinct biomolecules 2,3,4,5, 6. This process has produced tremendous insights into the mechanisms of molecular adaptation and functional divergence7. Despite such insights, a major criticism of ASR is the general inability to benchmark accuracy of the implemented algorithms. It is difficult to benchmark ASR for many reasons. Notably, genetic material is not preserved in fossils on a long enough time scale to satisfy most ASR studies (many millions to billions of years ago), and it is not yet physically possible to travel back in time to collect samples. Reference can be made to Cai et al., "Reconstruction of ancestral protein sequences and its applications," BMC Evolutionary Biology 2004, 4:33 and Zakas et al., "Enhancing the pharmaceutical properties of protein drugs by ancestral sequence reconstruction," Nature Biotechnology, 35, pp. 35-37 (2017), each of which are incorporated herein by reference.

There are many software packages available which can perform ancestral state reconstruction. Generally, these software packages have been developed and maintained through the efforts of scientists in related fields and released under free software licenses. The following list is not meant to be a comprehensive itemization of all available packages, but provides a representative sample of the extensive variety of packages that implement methods of ancestral reconstruction with different strengths and features: *PAML* (Phylogenetic Analysis by Maximum Likelihood, available at //abacus.gene.ucl.ac.uk/software/paml.html), *BEAST* (Bayesian evolutionary analysis by sampling trees, available at //www.beast2.org/wiki/index.php/Main_Page), and *Diversitree* (FitzJohn R G, 2012. Diversitree: comparative phylogenetic analyses of diversification in R. Methods in Ecology and Evolution), and *HyPHy* (Hypothesis testing using phylogenies, available at //hyphy.org/w/index.php/Main_Page).

The Examples demonstrate one embodiment for using ASR to increase overall expression of base editors disclosed herein.

The above description is meant to be non-limiting with regard to making base editors having increased expression, and thereby increase editing efficiencies.

Increasing Nuclear Localization

In one aspect, the specification provides a strategy for improving a base editor by incorporating one or more nuclear localization signals (NLS) therein, e.g., as a N-terminal or C-terminal fusion protein. Preferably, at least two NLSs are incorporated into a base editor. In the Examples, the inventors explored whether sub-optimal nuclear localization could be a basis or poor editing efficiency. The inventors test six combinations of the base editor "BE4" as N- and/or C-terminal fusions to either the SV40 NLS or the bipartite NLS (bpNLS). As shown in the Examples, all the variants using one or two bpNLSs showed improvements in editing efficiency. The presence of a bpNLS at both the N- and C-terminus (referred to hereafter as "bis-bpNLS") performed best, resulting in a 1.3-fold average improvement in BE4-mediated C·G-to-T·A editing efficiency at five exemplary tested genomic loci (48±8.0% average editing compared to 37±5.6% for the C-terminal SV40 NLS used in BE4). These results together suggest that modifying base editors with one or more nuclear localization signals, e.g., a bis-bpNLS, can significantly improve the editing efficiency of previously described for known base editors, such as, BE3 and BE4 (6, 7).

However, the Examples are not intended to be limiting, but only demonstrative of wider strategy for improving base editor efficiency through the modification of the base editor with one or more nuclear localization signals, preferably at least two NLSs. The invention is not intended to be limiting with regard to which NLS is employed, and the manner by which the NLS is attached to or otherwise coupled to a base editor. NLS sequences are known in the art and examples are disclosed herein.

Vectors

Several aspects of the making and using the base editors of the invention relate to vector systems comprising one or more vectors, or vectors as such. Vectors can be designed to clone and/or express the improved base editors of the disclosure. Vectors can also be designed to transfect the improved base editors of the disclosure into one or more cells, e.g., a target diseased eukaryotic cell for treatment with the base editor systems and methods disclosed herein.

Vectors can be designed for expression of base editor transcripts (e.g. nucleic acid transcripts, proteins, or enzymes) in prokaryotic or eukaryotic cells. For example, base editor transcripts can be expressed in bacterial cells such as *Escherichia coli*, insect cells (using baculovirus expression vectors), yeast cells, or mammalian cells. Suitable host cells are discussed further in Goeddel, GENE EXPRESSION TECHNOLOGY: METHODS IN ENZYMOLOGY 185, Academic Press. San Diego, Calif. (1990). Alternatively, expression vectors encoding one or more improved base editors described herein can be transcribed and translated in vitro, for example using T7 promoter regulatory sequences and T7 polymerase.

Vectors may be introduced and propagated in a prokaryotic cells. In some embodiments, a prokaryote is used to amplify copies of a vector to be introduced into a eukaryotic cell or as an intermediate vector in the production of a vector to be introduced into a eukaryotic cell (e.g. amplifying a plasmid as part of a viral vector packaging system). In some embodiments, a prokaryote is used to amplify copies of a vector and express one or more nucleic acids, such as to provide a source of one or more proteins for delivery to a host cell or host organism. Expression of proteins in prokaryotes is most often carried out in *Escherichia coli* with vectors containing constitutive or inducible promoters directing the expression of either fusion or non-fusion proteins.

Fusion expression vectors also may be used to express the improved base editors of the disclosure. Such vectors generally add a number of amino acids to a protein encoded therein, such as to the amino terminus of the recombinant protein. Such fusion vectors may serve one or more purposes, such as: (i) to increase expression of recombinant protein; (ii) to increase the solubility of the recombinant protein; and (iii) to aid in the purification of the recombinant protein by acting as a ligand in affinity purification. Often, in fusion expression vectors, a proteolytic cleavage site is introduced at the junction of the fusion moiety and the recombinant protein to enable separation of the recombinant protein from the fusion moiety subsequent to purification of the fusion protein. Such enzymes, and their cognate recognition sequences, include Factor Xa, thrombin and enterokinase. Example fusion expression vectors include pGEX (Pharmacia Biotech Inc; Smith and Johnson, 1988. *Gene* 67: 31-40), pMAL (New England Biolabs, Beverly, Mass.) and pRIT5 (Pharmacia, Piscataway, N.J.) that fuse glutathione S-transferase (GST), maltose E binding protein, or protein A, respectively, to the target recombinant protein.

Examples of suitable inducible non-fusion *E. coli* expression vectors include pTrc (Amrann et al., (1988) *Gene* 69:301-315) and pET 11d (Studier et al., GENE EXPRESSION TECHNOLOGY: METHODS IN ENZYMOLOGY 185, Academic Press, San Diego, Calif. (1990) 60-89).

In some embodiments, a vector is a yeast expression vector for expressing the improved base editors described herein. Examples of vectors for expression in yeast *Saccharomyces* cerevisae include pYepSec1 (Baldari, et al., 1987. *EMBO J.* 6: 229-234), pMFa (Kuijan and Herskowitz, 1982. *Cell* 30: 933-943), pJRY88 (Schultz et al., 1987. *Gene* 54: 113-123), pYES2 (Invitrogen Corporation, San Diego, Calif.), and picZ (InVitrogen Corp, San Diego, Calif.).

In some embodiments, a vector drives protein expression in insect cells using baculovirus expression vectors. Baculovirus vectors available for expression of proteins in cultured insect cells (e.g., SF9 cells) include the pAc series (Smith, et al., 1983. *Mol. Cell. Biol.* 3: 2156-2165) and the pVL series (Lucklow and Summers, 1989. *Virology* 170: 31-39).

In some embodiments, a vector is capable of driving expression of one or more sequences in mammalian cells using a mammalian expression vector. Examples of mammalian expression vectors include pCDM8 (Seed, 1987. *Nature* 329: 840) and pMT2PC (Kaufman, et al., 1987. *EMBO J.* 6: 187-195). When used in mammalian cells, the expression vector's control functions are typically provided by one or more regulatory elements. For example, commonly used promoters are derived from polyoma, adenovirus 2, cytomegalovirus, simian virus 40, and others disclosed herein and known in the art. For other suitable expression systems for both prokaryotic and eukaryotic cells see, e.g., Chapters 16 and 17 of Sambrook, et al., MOLECULAR CLONING: A LABORATORY MANUAL. 2nd ed., Cold Spring Harbor Laboratory, Cold Spring Harbor Laboratory Press, Cold Spring Harbor, N.Y., 1989.

In some embodiments, the recombinant mammalian expression vector is capable of directing expression of the nucleic acid preferentially in a particular cell type (e.g., tissue-specific regulatory elements are used to express the nucleic acid). Tissue-specific regulatory elements are known in the art. Non-limiting examples of suitable tissue-specific promoters include the albumin promoter (liver-specific; Pinkert, et al., 1987. *Genes Dev.* 1: 268-277), lymphoid-specific promoters (Calame and Eaton, 1988. *Adv. Immunol.* 43: 235-275), in particular promoters of T cell receptors (Winoto and Baltimore, 1989. *EMBO J.* 8: 729-733) and immunoglobulins (Baneiji, et al., 1983. *Cell* 33: 729-740; Queen and Baltimore, 1983. Cell 33: 741-748), neuron-specific promoters (e.g., the neurofilament promoter; Byrne and Ruddle, 1989. *Proc. Natl. Acad. Sci. USA* 86: 5473-5477), pancreas-specific promoters (Edlund, et al., 1985. *Science* 230: 912-916), and mammary gland-specific promoters (e.g., milk whey promoter, U.S. Pat. No. 4,873,316 and European Application Publication No. 264,166). Developmentally-regulated promoters are also encompassed, e.g., the murine hox promoters (Kessel and Gruss, 1990. *Science* 249: 374-379) and the α-fetoprotein promoter (Campes and Tilghman, 1989. *Genes Dev.* 3: 537-546).

Increasing Base Editor Efficiencies

Some aspects of the disclosure are based on the recognition that any of the base editors provided herein are capable of modifying a specific nucleotide base without generating a significant proportion of indels. An "indel", as used herein, refers to the insertion or deletion of a nucleotide base within a nucleic acid. Such insertions or deletions can lead to frame shift mutations within a coding region of a gene. In some embodiments, it is desirable to generate base editors that efficiently modify (e.g. mutate or deaminate) a specific nucleotide within a nucleic acid, without generating a large number of insertions or deletions (i.e., indels) in the nucleic acid. In certain embodiments, any of the base editors provided herein are capable of generating a greater proportion of intended modifications (e.g., point mutations or deaminations) versus indels. In some embodiments, the base editors provided herein are capable of generating a ratio of intended point mutations to indels that is greater than 1:1. In some embodiments, the base editors provided herein are capable of generating a ratio of intended point mutations to indels that is at least 1.5:1, at least 2:1, at least 2.5:1, at least 3:1, at least 3.5:1, at least 4:1, at least 4.5:1, at least 5:1, at least 5.5:1, at least 6:1, at least 6.5:1, at least 7:1, at least 7.5:1, at least 8:1, at least 10:1, at least 12:1, at least 15:1, at least 20:1, at least 25:1, at least 30:1, at least 40:1, at least 50:1, at least 100:1, at least 200:1, at least 300:1, at least 400:1, at least 500:1, at least 600:1, at least 700:1, at least 800:1, at least 900:1, or at least 1000:1, or more. The number of intended mutations and indels may be determined using any suitable method, for example the methods used in the below Examples. In some embodiments, to calculate indel frequencies, sequencing reads are scanned for exact matches to two 10-bp sequences that flank both sides of a window in which indels might occur. If no exact matches are located, the read is excluded from analysis. If the length of this indel window exactly matches the reference sequence the read is classified as not containing an indel. If the indel window is two or more bases longer or shorter than the reference sequence, then the sequencing read is classified as an insertion or deletion, respectively.

In some embodiments, the base editors provided herein are capable of limiting formation of indels in a region of a nucleic acid. In some embodiments, the region is at a nucleotide targeted by a base editor or a region within 2, 3, 4, 5, 6, 7, 8, 9, or 10 nucleotides of a nucleotide targeted by a base editor. In some embodiments, any of the base editors provided herein are capable of limiting the formation of indels at a region of a nucleic acid to less than 1%, less than 1.5%, less than 2%, less than 2.5%, less than 3%, less than 3.5%, less than 4%, less than 4.5%, less than 5%, less than 6%, less than 7%, less than 8%, less than 9%, less than 10%, less than 12%, less than 15%, or less than 20%. The number of indels formed at a nucleic acid region may depend on the amount of time a nucleic acid (e.g., a nucleic acid within the genome of a cell) is exposed to a base editor. In some embodiments, an number or proportion of indels is determined after at least 1 hour, at least 2 hours, at least 6 hours, at least 12 hours, at least 24 hours, at least 36 hours, at least 48 hours, at least 3 days, at least 4 days, at least 5 days, at least 7 days, at least 10 days, or at least 14 days of exposing a nucleic acid (e.g., a nucleic acid within the genome of a cell) to a base editor.

Some aspects of the disclosure are based on the recognition that any of the base editors provided herein are capable of efficiently generating an intended mutation, such as a point mutation, in a nucleic acid (e.g. a nucleic acid within a genome of a subject) without generating a significant number of unintended mutations, such as unintended point mutations. In some embodiments, a intended mutation is a mutation that is generated by a specific base editor bound to a gRNA, specifically designed to generate the intended mutation. In some embodiments, the intended mutation is a mutation associated with a disease or disorder. In some embodiments, the intended mutation is a adenine (A) to guanine (G) point mutation associated with a disease or disorder. In some embodiments, the intended mutation is a thymine (T) to cytosine (C) point mutation associated with a disease or disorder. In some embodiments, the intended mutation is a adenine (A) to guanine (G) point mutation within the coding region of a gene. In some embodiments, the intended mutation is a thymine (T) to cytosine (C) point mutation within the coding region of a gene. In some embodiments, the intended mutation is a point mutation that generates a stop codon, for example, a premature stop codon within the coding region of a gene. In some embodiments, the intended mutation is a mutation that eliminates a stop codon. In some embodiments, the intended mutation is a mutation that alters the splicing of a gene. In some embodiments, the intended mutation is a mutation that alters the regulatory sequence of a gene (e.g., a gene promotor or gene repressor). In some embodiments, any of the base editors provided herein are capable of generating a ratio of intended mutations to unintended mutations (e.g., intended point mutations:unintended point mutations) that is greater than 1:1. In some embodiments, any of the base editors provided herein are capable of generating a ratio of intended mutations to unintended mutations (e.g., intended point mutations:unintended point mutations) that is at least 1.5:1, at least 2:1, at least 2.5:1, at least 3:1, at least 3.5:1, at least 4:1, at least 4.5:1, at least 5:1, at least 5.5:1, at least 6:1, at least 6.5:1, at least 7:1, at least 7.5:1, at least 8:1, at least 10:1, at least 12:1, at least 15:1, at least 20:1, at least 25:1, at least 30:1, at least 40:1, at least 50:1, at least 100:1, at least 150:1, at least 200:1, at least 250:1, at least 500:1, or at least 1000:1, or more. It should be appreciated that the characteristics of the base editors described in the "Base Editor Efficiency" section, herein, may be applied to any of the fusion proteins, or methods of using the fusion proteins provided herein.

III. Methods of Using Improved Base-Editors

Some aspects of this disclosure provide methods of using the improved base editors disclosed herein, or base editor complexes comprising one or more napR/DNAbp-programming nucleic acid molecules (e.g., Cas9 guide RNAs) and a nucleobase editor provided herein.
Editing DNA or RNA Some aspects of the disclosure provide methods for editing a nucleic acid using the base editors described herein. In some embodiments, the method is a method for editing a nucleobase of a nucleic acid (e.g., a base pair of a double-stranded DNA sequence). In some embodiments, the method comprises the steps of: a) contacting a target region of a nucleic acid (e.g., a double-stranded DNA sequence) with a complex comprising a base editor (e.g., a Cas9 domain fused to an adenosine deaminase) and a guide nucleic acid (e.g., gRNA), wherein the target region comprises a targeted nucleobase pair, b) inducing strand separation of said target region, c) converting a first nucleobase of said target nucleobase pair in a single strand of the target region to a second nucleobase, and d) cutting no more than one strand of said target region, where a third nucleobase complementary to the first nucleobase base is replaced by a fourth nucleobase complementary to the second nucleobase. In some embodiments, the method results in less than 20% indel formation in the nucleic acid. It should be appreciated that in some embodiments, step b is omitted. In some embodiments, the first nucleobase is an adenine. In some embodiments, the second nucleobase is a deaminated adenine, or inosine. In some embodiments, the third nucleobase is a thymine. In some embodiments, the fourth nucleobase is a cytosine. In some embodiments, the method results in less than 19%, 18%, 16%, 14%, 12%, 10%, 8%, 6%, 4%, 2%, 1%, 0.5%, 0.2%, or less than 0.1% indel formation. In some embodiments, the method further comprises replacing the second nucleobase with a fifth nucleobase that is complementary to the fourth nucleobase, thereby generating an intended edited base pair (e.g., A:T to G:C). In some embodiments, the fifth nucleobase is a guanine. In some embodiments, at least 5% of the intended base pairs are edited. In some embodiments, at least 10%, 15%, 20%, 25%, 30%, 35%, 40%, 45%, or 50% of the intended base pairs are edited.

In some embodiments, the ratio of intended products to unintended products in the target nucleotide is at least 2:1, 5:1, 10:1, 20:1, 30:1, 40:1, 50:1, 60:1, 70:1, 80:1, 90:1, 100:1, or 200:1, or more. In some embodiments, the ratio of intended point mutation to indel formation is greater than 1:1, 10:1, 50:1, 100:1, 500:1, or 1000:1, or more. In some embodiments, the cut single strand (nicked strand) is hybridized to the guide nucleic acid. In some embodiments, the cut single strand is opposite to the strand comprising the first nucleobase. In some embodiments, the base editor comprises a Cas9 domain. In some embodiments, the first base is adenine, and the second base is not a G, C, A, or T. In some embodiments, the second base is inosine. In some embodiments, the first base is adenine. In some embodiments, the second base is not a G, C, A, or T. In some embodiments, the second base is inosine. In some embodiments, the base editor inhibits base excision repair of the edited strand. In some embodiments, the base editor protects or binds the non-edited strand. In some embodiments, the base editor comprises UGI activity. In some embodiments, the base editor comprises a catalytically inactive inosine-specific nuclease. In some embodiments, the base editor comprises nickase activity. In some embodiments, the intended edited base pair is upstream of a PAM site. In some embodiments, the intended edited base pair is 1, 2, 3, 4, 5, 6, 7, 8, 9, 10, 11, 12, 13, 14, 15, 16, 17, 18, 19, or 20 nucleotides upstream of the PAM site. In some embodiments, the intended edited basepair is downstream of a PAM site. In some embodiments, the intended edited base pair is 1, 2, 3, 4, 5, 6, 7, 8, 9, 10, 11, 12, 13, 14, 15, 16, 17, 18, 19, or 20 nucleotides downstream of the PAM site. In some embodiments, the method does not require a canonical (e.g., NGG) PAM site. In some embodiments, the nucleobase editor comprises a linker. In some embodiments, the linker is 1-25 amino acids in length. In some embodiments, the linker is 5-20 amino acids in length. In some embodiments, linker is 10, 11, 12, 13, 14, 15, 16, 17, 18, 19, or 20 amino acids in length. In some embodiments, the target region comprises a target window, wherein the target window comprises the target nucleobase pair. In some embodiments, the target window comprises 1-10 nucleotides. In some embodiments, the target window is 1-9, 1-8, 1-7, 1-6, 1-5, 1-4, 1-3, 1-2, or 1 nucleotides in length. In some embodiments, the target window is 1, 2, 3, 4, 5, 6, 7, 8, 9, 10, 11, 12, 13, 14, 15, 16, 17, 18, 19, or 20 nucleotides in length. In some embodiments, the intended edited base pair is within the target window. In some embodiments, the target window comprises the intended edited base pair. In some embodiments, the method is performed using any of the base editors provided herein. In some embodiments, a target window is a deamination window.

In some embodiments, the disclosure provides methods for editing a nucleotide. In some embodiments, the disclosure provides a method for editing a nucleobase pair of a double-stranded DNA sequence. In some embodiments, the method comprises a) contacting a target region of the double-stranded DNA sequence with a complex comprising a base editor and a guide nucleic acid (e.g., gRNA), where the target region comprises a target nucleobase pair, b) inducing strand separation of said target region, c) converting a first nucleobase of said target nucleobase pair in a single strand of the target region to a second nucleobase, d) cutting no more than one strand of said target region, wherein a third nucleobase complementary to the first nucleobase base is replaced by a fourth nucleobase complementary to the second nucleobase, and the second nucleobase is replaced with a fifth nucleobase that is complementary to the fourth nucleobase, thereby generating an intended edited base pair, wherein the efficiency of generating the intended edited base pair is at least 5%. It should be appreciated that in some embodiments, step b is omitted. In some embodiments, at least 5% of the intended base pairs are edited. In some embodiments, at least 10%, 15%, 20%, 25%, 30%, 35%, 40%, 45%, or 50% of the intended base pairs are edited. In some embodiments, the method causes less than 19%, 18%, 16%, 14%, 12%, 10%, 8%, 6%, 4%, 2%, 1%, 0.5%, 0.2%, or less than 0.1% indel formation. In some embodiments, the ratio of intended product to unintended products at the target nucleotide is at least 2:1, 5:1, 10:1, 20:1, 30:1, 40:1, 50:1, 60:1, 70:1, 80:1, 90:1, 100:1, or 200:1, or more. In some embodiments, the ratio of intended point mutation to indel formation is greater than 1:1, 10:1, 50:1, 100:1, 500:1, or 1000:1, or more. In some embodiments, the cut single strand is hybridized to the guide nucleic acid. In some embodiments, the cut single strand is opposite to the strand comprising the first nucleobase. In some embodiments, the first base is adenine. In some embodiments, the second nucleobase is not G, C, A, or T. In some embodiments, the second base is inosine. In some embodiments, the base editor inhibits base excision repair of the edited strand. In some embodiments, the base editor protects (e.g., form base excision repair) or binds the non-edited strand. In some embodiments, the nucleobase editor comprises UGI activity. In some embodiments, the base editor comprises a catalytically inactive inosine-specific nuclease. In some embodiments, the nucleobase editor comprises nickase activity. In some embodiments, the intended edited base pair is upstream of a PAM site. In some embodiments, the intended edited base pair is 1, 2, 3, 4, 5, 6, 7, 8, 9, 10, 11, 12, 13, 14, 15, 16, 17, 18, 19, or 20 nucleotides upstream of the PAM site. In some embodiments, the intended edited basepair is downstream of a PAM site. In some embodiments, the intended edited base pair is 1, 2, 3, 4, 5, 6, 7, 8, 9, 10, 11, 12, 13, 14, 15, 16, 17, 18, 19, or 20 nucleotides downstream stream of the PAM site. In some embodiments, the method does not require a canonical (e.g., NGG) PAM site. In some embodiments, the nucleobase editor comprises a linker. In some embodiments, the linker is 1-25 amino acids in length. In some embodiments, the linker is 5-20 amino acids in length. In some embodiments, the linker is 10, 11, 12, 13, 14, 15, 16, 17, 18, 19, or 20 amino acids in length. In some embodiments, the target region comprises a target window, wherein the target window comprises the target nucleobase pair. In some embodiments, the target window comprises 1-10 nucleotides. In some embodiments, the target window is 1-9, 1-8, 1-7, 1-6, 1-5, 1-4, 1-3, 1-2, or 1 nucleotides in length. In some embodiments, the target window is 1, 2, 3, 4, 5, 6, 7, 8, 9, 10, 11, 12, 13, 14, 15, 16, 17, 18, 19, or 20 nucleotides in length. In some embodiments, the intended edited base pair occurs within the target window. In some embodiments, the target window comprises the intended edited base pair. In some embodiments, the nucleobase editor is any one of the base editors provided herein.

In another embodiment, the disclosure provides editing methods comprising contacting a DNA, or RNA molecule with any of the base editors provided herein, and with at least one guide nucleic acid (e.g., guide RNA), wherein the guide nucleic acid, (e.g., guide RNA) is about 15-100 nucleotides long and comprises a sequence of at least 10 contiguous nucleotides that is complementary to a target sequence. In some embodiments, the 3' end of the target sequence is immediately adjacent to a canonical PAM sequence (NGG). In some embodiments, the 3' end of the target sequence is not immediately adjacent to a canonical PAM sequence (NGG). In some embodiments, the 3' end of the target sequence is immediately adjacent to an AGC, GAG, TTT, GTG, or CAA sequence.

In some embodiments, the target DNA sequence comprises a sequence associated with a disease or disorder. In some embodiments, the target DNA sequence comprises a point mutation associated with a disease or disorder. In some embodiments, the activity of the fusion protein (e.g., comprising an adenosine deaminase and a Cas9 domain), or the complex, results in a correction of the point mutation. In some embodiments, the target DNA sequence comprises a G→A point mutation associated with a disease or disorder, and wherein the deamination of the mutant A base results in a sequence that is not associated with a disease or disorder. In some embodiments, the target DNA sequence encodes a protein, and the point mutation is in a codon and results in a change in the amino acid encoded by the mutant codon as compared to the wild-type codon. In some embodiments, the deamination of the mutant A results in a change of the amino acid encoded by the mutant codon. In some embodiments, the deamination of the mutant A results in the codon encoding the wild-type amino acid. In some embodiments, the contacting is in vivo in a subject. In some embodiments, the subject has or has been diagnosed with a disease or disorder. In some embodiments, the disease or disorder is phenylketonuria, von Willebrand disease (vWD), a neoplastic disease associated with a mutant PTEN or BRCA1, or Li-Fraumeni syndrome. A list of exemplary diseases and disorders that may be treated using the base editors described herein is shown in Table 1. Table 1 includes the target gene, the mutation to be corrected, the related disease and the nucleotide sequence of the associated protospacer and PAM.

TABLE 1

List of exemplary diseases that may be treated using the base editors described herein. The A to be edited in the protospacer is indicated by underlining and the PAM is indicated in bold.

| Target Gene | Mutation | ATCC Cell Line | Disease | Protospacer and PAM |
|---|---|---|---|---|
| PTEN | Cys136Tyr | HTB-128 | Cancer Predisposition | TATATGCATATTTATTACATCGG SEQ ID NO: 140 |
| PTEN | Arg233Ter | HTB-13 | Cancer Predisposition | CCGTCATGTGGGTCCTGAATTGG SEQ ID NO: 141 |
| TP53 | Glu258Lys | RTB-65 | Cancer Predisposition | ACACTGAAAGACTCCAGGTCAGG SEQ ID NO: 142 |
| BRCA1 | Gly1738Arg | NA | Cancer Predisposition | GTCAGAAGAGATGTGGTCAATGG SEQ ID NO: 143 |
| BRCA1 | 4097-1G>A | NA | Cancer Predisposition | TTTAAAGTGAAGCAGCATCTGGG SEQ ID NO: 144<br>ATTTAAAGTGAAGCAGCATCTGG SEQ ID NO: 145 |
| PAH | Thr380Met | NA | Phenylketonuria | ACTCCATGACAGTGTAATTTTGG SEQ ID NO: 146 |
| VWF | Ser1285Phe | NA | von Willebrand (Hemophilia) | GCCTGGAGAAGCCATCCAGCAGG SEQ ID NO: 147 |
| VWF | Arg2535Ter | NA | von Willebrand (Hemophilia) | CTCAGACACACTCATTGATGAGG SEQ ID NO: 148 |
| TP53 | Arg175His | HCC1395 | Li-Fraumeni syndrome | GAGGCACTGCCCCCACCAT-GAGCG SEQ ID NO: 149 |

Some embodiments provide methods for using the improved base editors provided herein. In some embodiments, the base editors are used to introduce a point mutation into a nucleic acid by deaminating a target nucleobase, e.g., an A residue. In some embodiments, the deamination of the target nucleobase results in the correction of a genetic defect, e.g., in the correction of a point mutation that leads to a loss of function in a gene product. In some embodiments, the genetic defect is associated with a disease or disorder, e.g., a lysosomal storage disorder or a metabolic disease, such as, for example, type I diabetes. In some embodiments, the methods provided herein are used to introduce a deactivating point mutation into a gene or allele that encodes a gene product that is associated with a disease or disorder. For example, in some embodiments, methods are provided herein that employ a DNA editing fusion protein to introduce a deactivating point mutation into an oncogene (e.g., in the treatment of a proliferative disease). A deactivating mutation may, in some embodiments, generate a premature stop codon in a coding sequence, which results in the expression of a truncated gene product, e.g., a truncated protein lacking the function of the full-length protein.

In some embodiments, the purpose of the methods provided herein is to restore the function of a dysfunctional gene via genome editing. The nucleobase editing proteins provided herein can be validated for gene editing-based human therapeutics in vitro, e.g., by correcting a disease-associated mutation in human cell culture. It will be understood by the skilled artisan that the nucleobase editing proteins provided herein, e.g., the fusion proteins comprising a nucleic acid programmable DNA binding protein (e.g., Cas9) and an adenosine deaminase domain can be used to correct any single point G to A or C to T mutation. In the first case, deamination of the mutant A to I corrects the mutation, and in the latter case, deamination of the A that is base-paired with the mutant T, followed by a round of replication, corrects the mutation. Exemplary point mutations that can be corrected are listed in Tables 1.

The successful correction of point mutations in disease-associated genes and alleles opens up new strategies for gene correction with applications in therapeutics and basic research. Site-specific single-base modification systems like the disclosed fusions of a nucleic acid programmable DNA binding protein and an adenosine deaminase domain also have applications in "reverse" gene therapy, where certain gene functions are purposely suppressed or abolished. In these cases, site-specifically mutating residues that lead to inactivating mutations in a protein, or mutations that inhibit function of the protein can be used to abolish or inhibit protein function Methods of Treatment The instant disclosure provides methods for the treatment of a subject diagnosed with a disease associated with or caused by a point mutation that can be corrected by a DNA editing fusion protein provided herein. For example, in some embodiments, a method is provided that comprises administering to a subject having such a disease, e.g., a cancer associated with a point mutation as described above, an effective amount of an adenosine deaminase fusion protein that corrects the point mutation or introduces a deactivating mutation into a disease-associated gene. In some embodiments, the disease is a proliferative disease. In some embodiments, the disease is a genetic disease. In some embodiments, the disease is a neoplastic disease. In some embodiments, the disease is a metabolic disease. In some embodiments, the disease is a lysosomal storage disease. Other diseases that can be treated by correcting a point mutation or introducing a deactivating mutation into a disease-associated gene will be known to those of skill in the art, and the disclosure is not limited in this respect.

The instant disclosure provides methods for the treatment of additional diseases or disorders, e.g., diseases or disorders that are associated or caused by a point mutation that can be corrected by deaminase-mediated gene editing. Some such diseases are described herein, and additional suitable diseases that can be treated with the strategies and fusion proteins provided herein will be apparent to those of skill in the art based on the instant disclosure. Exemplary suitable diseases and disorders are listed below. It will be understood that the numbering of the specific positions or residues in the respective sequences depends on the particular protein and numbering scheme used. Numbering might be different, e.g., in precursors of a mature protein and the mature protein itself, and differences in sequences from species to species may affect numbering. One of skill in the art will be able to identify the respective residue in any homologous protein and in the respective encoding nucleic acid by methods well known in the art, e.g., by sequence alignment and determination of homologous residues. Exemplary suitable diseases and disorders include, without limitation: 2-methyl-3-hydroxybutyric aciduria; 3 beta-Hydroxysteroid dehydrogenase deficiency; 3-Methylglutaconic aciduria; 3-Oxo-5 alpha-steroid delta 4-dehydrogenase deficiency; 46,XY sex reversal, type 1, 3, and 5; 5-Oxoprolinase deficiency; 6-pyruvoyl-tetrahydropterin synthase deficiency; Aarskog syndrome; Aase syndrome; Achondrogenesis type 2; Achromatopsia 2 and 7; Acquired long QT syndrome; Acrocallosal syndrome, Schinzel type; Acrocapitofemoral dysplasia; Acrodysostosis 2, with or without hormone resistance; Acroerythrokeratoderma; Acromicric dysplasia; Acth-independent macronodular adrenal hyperplasia 2; Activated PI3K-delta syndrome; Acute intermittent *porphyria*; deficiency of Acyl-CoA dehydrogenase family, member 9; Adams-Oliver syndrome 5 and 6; Adenine phosphoribosyltransferase deficiency; Adenylate kinase deficiency; hemolytic anemia due to Adenylosuccinate lyase deficiency; Adolescent nephronophthisis; Renal-hepatic-pancreatic dysplasia; Meckel syndrome type 7; Adrenoleukodystrophy; Adult junctional epidermolysis bullosa; Epidermolysis bullosa, junctional, localisata variant; Adult neuronal ceroid lipofuscinosis; Adult neuronal ceroid lipofuscinosis; Adult onset ataxia with oculomotor apraxia; ADULT syndrome; Afibrinogenemia and congenital Afibrinogenemia; autosomal recessive Agammaglobulinemia 2; Age-related macular degeneration 3, 6, 11, and 12; Aicardi Goutieres syndromes 1, 4, and 5; Chilbain lupus 1; Alagille syndromes 1 and 2; Alexander disease; Alkaptonuria; Allan-Herndon-Dudley syndrome; Alopecia universalis congenital; Alpers encephalopathy; Alpha-1-antitrypsin deficiency; autosomal dominant, autosomal recessive, and X-linked recessive Alport syndromes; Alzheimer disease, familial, 3, with spastic paraparesis and apraxia; Alzheimer disease, types, 1, 3, and 4; hypocalcification type and hypomaturation type, IIA1 Amelogenesis imperfecta; Aminoacylase 1 deficiency; Amish infantile epilepsy syndrome; Amyloidogenic transthyretin amyloidosis; Amyloid Cardiomyopathy, Transthyretin-related; Cardiomyopathy; Amyotrophic lateral sclerosis types 1, 6, 15 (with or without frontotemporal dementia), 22 (with or without frontotemporal dementia), and 10; Frontotemporal dementia with TDP43 inclusions, TARDBP-related; Andermann syndrome; Andersen Tawil syndrome; Congenital long QT syndrome; Anemia, nonspherocytic hemolytic, due to G6PD deficiency; Angelman syndrome; Severe neonatal-onset encephalopathy with microcephaly; susceptibility to Autism, X-linked 3; Angiopathy, hereditary, with nephropathy, aneurysms, and muscle cramps; Angiotensin i-converting enzyme, benign serum increase; Aniridia, cerebellar ataxia, and mental retardation; Anonychia; Antithrombin III deficiency; Antley-Bixler syndrome with genital anomalies and disordered steroidogenesis; Aortic aneurysm, familial thoracic 4, 6, and 9; Thoracic aortic aneurysms and aortic dissections; Multisystemic smooth muscle dysfunction syndrome; Moyamoya disease 5; Aplastic anemia; Apparent mineralocorticoid excess; Arginase deficiency; Argininosuccinate lyase deficiency; Aromatase deficiency; Arrhythmogenic right ventricular cardiomyopathy types 5, 8, and 10; Primary familial hypertrophic cardiomyopathy; Arthrogryposis multiplex congenita, distal, X-linked; Arthrogryposis renal dysfunction cholestasis syndrome; Arthrogryposis, renal dysfunction, and cholestasis 2; Asparagine synthetase deficiency; Abnormality of neuronal migration; Ataxia with vitamin E deficiency; Ataxia, sensory, autosomal dominant; Ataxia-telangiectasia syndrome; Hereditary cancer-predisposing syndrome; Atransferrinemia; Atrial fibrillation, familial, 11, 12, 13, and 16; Atrial septal defects 2, 4, and 7 (with or without atrioventricular conduction defects); Atrial standstill 2; Atrioventricular septal defect 4; *Atrophia bulborum hereditaria*; ATR-X syndrome; Auriculocondylar syndrome 2; Autoimmune disease, multisystem, infantile-onset; Autoimmune lymphoproliferative syndrome, type 1a; Autosomal dominant hypohidrotic ectodermal dysplasia; Autosomal dominant progressive external ophthalmoplegia with mitochondrial DNA deletions 1 and 3; Autosomal dominant torsion dystonia 4; Autosomal recessive centronuclear myopathy; Autosomal recessive congenital ichthyosis 1, 2, 3, 4A, and 4B; Autosomal recessive cutis laxa type IA and 1B; Autosomal recessive hypohidrotic ectodermal dysplasia syndrome; Ectodermal dysplasia 11b; hypohidrotic/hair/tooth type, autosomal recessive; Autosomal recessive hypophosphatemic bone disease; Axenfeld-Rieger syndrome type 3; Bainbridge-Ropers syndrome; Bannayan-Riley-Ruvalcaba syndrome; PTEN hamartoma tumor syndrome; Baraitser-Winter syndromes 1 and 2; Barakat syndrome; Bardet-Biedl syndromes 1, 11, 16, and 19; Bare lymphocyte syndrome type 2, complementation group E; Bartter syndrome antenatal type 2; Bartter syndrome types 3, 3 with hypocalciuria, and 4; Basal ganglia calcification, idiopathic, 4; Beaded hair; Benign familial hematuria; Benign familial neonatal seizures 1 and 2; Seizures, benign familial neonatal, 1, and/or myokymia; Seizures, Early infantile epileptic encephalopathy 7; Benign familial neonatal-infantile seizures; Benign hereditary chorea; Benign scapuloperoneal muscular dystrophy with cardiomyopathy; Bernard-Soulier syndrome, types A1 and A2 (autosomal dominant); Bestrophinopathy, autosomal recessive; beta Thalassemia; Bethlem myopathy and Bethlem myopathy 2; Bietti crystalline corneoretinal dystrophy; Bile acid synthesis defect, congenital, 2; Biotinidase deficiency; Birk Barel mental retardation dysmorphism syndrome; Blepharophimosis, ptosis, and epicanthus inversus; Bloom syndrome; Borjeson-Forssman-Lehmann syndrome; Boucher Neuhauser syndrome; Brachydactyly types A1 and A2; Brachydactyly with hypertension; Brain small vessel disease with hemorrhage; Branched-chain ketoacid dehydrogenase kinase deficiency; Branchiootic syndromes 2 and 3; Breast cancer, early-onset; Breast-ovarian cancer, familial 1, 2, and 4; Brittle cornea syndrome 2; Brody myopathy; Bronchiectasis with or without elevated sweat chloride 3; Brown-Vialetto-Van laere syndrome and Brown-Vialetto-Van Laere syndrome 2; Brugada syndrome; Brugada syndrome 1; Ventricular fibrillation; Paroxysmal familial ventricular fibrillation; Brugada syndrome and Brugada syndrome 4; Long QT syndrome; Sudden cardiac death; Bull eye macular dystrophy; Stargardt disease 4; Cone-rod dystrophy 12; Bullous ichthyosiform erythroderma; Burn-Mckeown syndrome; Candidiasis, familial, 2, 5, 6, and 8; Carbohydrate-deficient glycoprotein syndrome type I and II; Carbonic anhydrase VA deficiency, hyperammonemia due to; Carcinoma of colon; Cardiac arrhythmia; Long QT syndrome, LQT1 subtype; Cardioencephalomyopathy, fatal infantile, due to cytochrome c oxidase deficiency; Cardiofaciocutaneous syndrome; Cardiomyopathy; Danon disease; Hypertrophic cardiomyopathy; Left ventricular noncompaction cardiomyopathy; Carnevale syndrome; Carney complex, type 1; Carnitine acylcarnitine translocase deficiency; Carnitine palmitoyltransferase I, II, II (late onset), and II (infantile) deficiency; Cataract 1, 4, autosomal dominant, autosomal dominant, multiple types, with microcornea, coppock-like, juvenile, with microcornea and glycosuria, and nuclear diffuse nonprogressive; Catecholaminergic polymorphic ventricular tachycardia; Caudal regression syndrome; Cd8 deficiency, familial; Central core disease; Centromeric instability of chromosomes 1, 9 and 16 and immunodeficiency; Cerebellar ataxia infantile with progressive external ophthalmoplegi and Cerebellar ataxia, mental retardation, and dysequilibrium syndrome 2; Cerebral amyloid angiopathy, APP-related; Cerebral autosomal dominant and recessive arteriopathy with subcortical infarcts and leukoencephalopathy; Cerebral cavernous malformations 2; Cerebrooculofacioskeletal syndrome 2; Cerebro-oculo-facioskeletal syndrome; Cerebroretinal microangiopathy with calcifications and cysts; Ceroid lipofuscinosis neuronal 2, 6, 7, and 10; Ch\xc3\xa9diak-Higashi syndrome, Chediak-Higashi syndrome, adult type; Charcot-Marie-Tooth disease types 1B, 2B2, 2C, 2F, 2I, 2U (axonal), 1C (demyelinating), dominant intermediate C, recessive intermediate A, 2A2, 4C, 4D, 4H, IF, IVF, and X; Scapuloperoneal spinal muscular atrophy; Distal spinal muscular atrophy, congenital nonprogressive; Spinal muscular atrophy, distal, autosomal recessive, 5; CHARGE association; Childhood hypophosphatasia; Adult hypophosphatasia; Cholecystitis; Progressive familial intrahepatic cholestasis 3; Cholestasis, intrahepatic, of pregnancy 3; Cholestanol storage disease; Cholesterol monooxygenase (side-chain cleaving) deficiency; Chondrodysplasia Blomstrand type; Chondrodysplasia punctata 1, X-linked recessive and 2 X-linked dominant; CHOPS syndrome; Chronic granulomatous disease, autosomal recessive cytochrome b-positive, types 1 and 2; Chudley-McCullough syndrome; Ciliary dyskinesia, primary, 7, 11, 15, 20 and 22; Citrullinemia type I; Citrullinemia type I and II; Cleidocranial dysostosis; C-like syndrome; Cockayne syndrome type A, Coenzyme Q10 deficiency, primary 1, 4, and 7; Coffin Siris/Intellectual Disability; Coffin-Lowry syndrome; Cohen syndrome, Cold-induced sweating syndrome 1; COLE-CARPENTER SYNDROME 2; Combined cellular and humoral immune defects with granulomas; Combined d-2- and 1-2-hydroxyglutaric aciduria; Combined malonic and methylmalonic aciduria; Combined oxidative phosphorylation deficiencies 1, 3, 4, 12, 15, and 25; Combined partial and complete 17-alpha-hydroxylase/17,20-lyase deficiency; Common variable immunodeficiency 9; Complement component 4, partial deficiency of, due to dysfunctional c1 inhibitor; Complement factor B deficiency; Cone monochromatism; Cone-rod dystrophy 2 and 6; Cone-rod dystrophy amylogenesis imperfecta; Congenital adrenal hyperplasia and Congenital adrenal hypoplasia, X-linked; Congenital megakaryocytic thrombocytopenia; Congenital aniridia; Congenital central hypoventilation; Hirschsprung disease 3; Congenital contractual arachnodactyly; Congenital contractures of the limbs and face, hypotonia, and developmental delay; Congenital disorder of glycosylation types 1B, 1D, 1G, 1H, 1J, 1K, 1N, 1P, 2C, 2J, 2K, IIm; Congenital dyserythropoietic anemia, type I and II; Congenital ectodermal dysplasia of face; Congenital erythropoietic porphyria; Congenital generalized lipodystrophy type 2; Congenital heart disease, multiple types, 2; Congenital heart disease; Interrupted aortic arch; Congenital lipomatous overgrowth, vascular malformations, and epidermal nevi; Non-small cell lung cancer; Neoplasm of ovary; Cardiac conduction defect, nonspecific; Congenital microvillus atrophy; Congenital muscular dystrophy; Congenital muscular dystrophy due to partial LAMA2 deficiency; Congenital muscular dystrophy-dystroglycanopathy with brain and eye anomalies, types A2, A7, A8, A11, and A14; Congenital muscular dystrophy-dystroglycanopathy with mental retardation, types B2, B3, B5, and B15; Congenital muscular dystrophy-dystroglycanopathy without mental retardation, type B5; Congenital muscular hypertrophy-cerebral syndrome; Congenital myasthenic syndrome, acetazolamide-responsive; Congenital myopathy with fiber type disproportion; Congenital ocular coloboma; Congenital stationary night blindness, type 1A, 1B, 1C, 1E, 1F, and 2A; Coproporphyria; Cornea plana 2; Corneal dystrophy, Fuchs endothelial, 4; Corneal endothelial dystrophy type 2; Corneal fragility keratoglobus, blue sclerae and joint hypermobility; Cornelia de Lange syndromes 1 and 5; Coronary artery disease, autosomal dominant 2; Coronary heart disease; Hyperalphalipoproteinemia 2; Cortical dysplasia, complex, with other brain malformations 5 and 6; Cortical malformations, occipital; Corticosteroid-binding globulin deficiency; Corticosterone methyloxidase type 2 deficiency; Costello syndrome; Cowden syndrome 1; Coxa plana; Craniodiaphyseal dysplasia, autosomal dominant; Craniosynostosis 1 and 4; Craniosynostosis and dental anomalies; Creatine deficiency, X-linked; Crouzon syndrome; Cryptophthalmos syndrome; Cryptorchidism, unilateral or bilateral; Cushing symphalangism; Cutaneous malignant melanoma 1; Cutis laxa with osteodystrophy and with severe pulmonary, gastrointestinal, and urinary abnormalities; Cyanosis, transient neonatal and atypical nephropathic; Cystic fibrosis; Cystinuria; Cytochrome c oxidase i deficiency; Cytochrome-c oxidase deficiency; D-2-hydroxyglutaric aciduria 2; Darier disease, segmental; Deafness with labyrinthine aplasia microtia and microdontia (LAMM); Deafness, autosomal dominant 3a, 4, 12, 13, 15, autosomal dominant nonsyndromic sensorineural 17, 20, and 65; Deafness, autosomal recessive 1A, 2, 3, 6, 8, 9, 12, 15, 16, 18b, 22, 28, 31, 44, 49, 63, 77, 86, and 89; Deafness, cochlear, with myopia and intellectual impairment, without vestibular involvement, autosomal dominant, X-linked 2; Deficiency of 2-methylbutyryl-CoA dehydrogenase; Deficiency of 3-hydroxyacyl-CoA dehydrogenase; Deficiency of alpha-mannosidase; Deficiency of aromatic-L-amino-acid decarboxylase; Deficiency of bisphosphoglycerate mutase; Deficiency of butyryl-CoA dehydrogenase; Deficiency of ferroxidase; Deficiency of galactokinase; Deficiency of guanidinoacetate methyltransferase; Deficiency of hyaluronoglucosaminidase; Deficiency of ribose-5-phosphate isomerase; Deficiency of steroid 11-beta-monooxygenase; Deficiency of UDPglucose-hexose-1-phosphate uridylyltransferase; Deficiency of xanthine oxidase; Dejerine-Sottas disease; Charcot-Marie-Tooth disease, types ID and IVF; Dejerine-Sottas syndrome, autosomal dominant; Dendritic cell, monocyte, B lymphocyte, and natural killer lymphocyte deficiency; Desbuquois dysplasia 2; Desbuquois syndrome; DFNA 2 Nonsyndromic Hearing Loss; Diabetes mellitus and insipidus with optic atrophy and deafness; Diabetes mellitus, type 2, and insulin-dependent, 20; Diamond-Blackfan anemia 1, 5, 8, and 10; Diarrhea 3 (secretory sodium, congenital, syndromic) and 5 (with tufting enteropathy, congenital); Dicarboxylic aminoaciduria; Diffuse palmoplantar keratoderma, Bothnian type; Digitorenocerebral syndrome; Dihydropteridine reductase deficiency; Dilated cardiomyopathy 1A, 1AA, 1C, 1G, 1BB, 1DD, 1FF, 1HH, 1I, 1KK, 1N, 1S, 1Y, and 3B; Left ventricular noncompaction 3; Disordered steroidogenesis due to cytochrome p450 oxidoreductase deficiency; Distal arthrogryposis type 2B; Distal hereditary motor neuronopathy type 2B; Distal myopathy Markesbery-Griggs type; Distal spinal muscular atrophy, X-linked 3; Distichiasis-lymphedema syndrome; Dominant dystrophic epidermolysis bullosa with absence of skin; Dominant hereditary optic atrophy; Donnai Barrow syndrome; Dopamine beta hydroxylase deficiency; Dopamine receptor d2, reduced brain density of; Dowling-degos disease 4; Doyne honeycomb retinal dystrophy; Malattia leventinese; Duane syndrome type 2; Dubin-Johnson syndrome; Duchenne muscular dystrophy; Becker muscular dystrophy; Dysfibrinogenemia; Dyskeratosis congenita autosomal dominant and autosomal dominant, 3; Dyskeratosis congenita, autosomal recessive, 1, 3, 4, and 5; Dyskeratosis congenita X-linked; Dyskinesia, familial, with facial myokymia; Dysplasminogenemia; Dystonia 2 (torsion, autosomal recessive), 3 (torsion, X-linked), 5 (Dopa-responsive type), 10, 12, 16, 25, 26 (Myoclonic); Seizures, benign familial infantile, 2; Early infantile epileptic encephalopathy 2, 4, 7, 9, 10, 11, 13, and 14; Atypical Rett syndrome; Early T cell progenitor acute lymphoblastic leukemia; Ectodermal dysplasia skin fragility syndrome; Ectodermal dysplasia-syndactyly syndrome 1; Ectopia lentis, isolated autosomal recessive and dominant; Ectrodactyly, ectodermal dysplasia, and cleft lip/palate syndrome 3; Ehlers-Danlos syndrome type 7 (autosomal recessive), classic type, type 2 (progeroid), hydroxylysine-deficient, type 4, type 4 variant, and due to tenascin-X deficiency; Eichsfeld type congenital muscular dystrophy; Endocrine-cerebroosteodysplasia; Enhanced s-cone syndrome; Enlarged vestibular aqueduct syndrome; Enterokinase deficiency; Epidermodysplasia verruciformis; Epidermolysa bullosa simplex and limb girdle muscular dystrophy, simplex with mottled pigmentation, simplex with pyloric atresia, simplex, autosomal recessive, and with pyloric atresia; Epidermolytic palmoplantar keratoderma; Familial febrile seizures 8; Epilepsy, childhood absence 2, 12 (idiopathic generalized, susceptibility to) 5 (nocturnal frontal lobe), nocturnal frontal lobe type 1, partial, with variable foci, progressive myoclonic 3, and X-linked, with variable learning disabilities and behavior disorders; Epileptic encephalopathy, childhood-onset, early infantile, 1, 19, 23, 25, 30, and 32; Epiphyseal dysplasia, multiple, with myopia and conductive deafness; Episodic ataxia type 2; Episodic pain syndrome, familial, 3; Epstein syndrome; Fechtner syndrome; Erythropoietic protoporphyria; Estrogen resistance; Exudative vitreoretinopathy 6; Fabry disease and Fabry disease, cardiac variant; Factor H, VII, X, v and factor viii, combined deficiency of 2, xiii, a subunit, deficiency; Familial adenomatous polyposis 1 and 3; Familial amyloid nephropathy with urticaria and deafness; Familial cold urticarial; Familial aplasia of the vermis; Familial benign pemphigus; Familial cancer of breast; Breast cancer, susceptibility to; Osteosarcoma; Pancreatic cancer 3; Familial cardiomyopathy; Familial cold autoinflammatory syndrome 2; Familial colorectal cancer; Familial exudative vitreoretinopathy, X-linked; Familial hemiplegic migraine types 1 and 2; Familial hypercholesterolemia; Familial hypertrophic cardiomyopathy 1, 2, 3, 4, 7, 10, 23 and 24; Familial hypokalemia-hypomagnesemia; Familial hypoplastic, glomerulocystic kidney; Familial infantile myasthenia; Familial juvenile gout; Familial Mediterranean fever and Familial mediterranean fever, autosomal dominant; Familial porencephaly; Familial *Porphyria cutanea tarda*; Familial pulmonary capillary hemangiomatosis; Familial renal glycosuria; Familial renal hyperuricemia; Familial restrictive cardiomyopathy 1; Familial type 1 and 3 hyperlipoproteinemia; Fanconi anemia, complementation group E, I, N, and O; Fanconi-Bickel syndrome; Favism, susceptibility to; Febrile seizures, familial, 11; Feingold syndrome 1; Fetal hemoglobin quantitative trait locus 1; FG syndrome and FG syndrome 4; Fibrosis of extraocular muscles, congenital, 1, 2, 3a (with or without extraocular involvement), 3b; Fish-eye disease; Fleck corneal dystrophy; Floating-Harbor syndrome; Focal epilepsy with speech disorder with or without mental retardation; Focal segmental glomerulosclerosis 5; Forebrain defects; Frank Ter Haar syndrome; Borrone Di Rocco Crovato syndrome; Frasier syndrome; Wilms tumor 1; Freeman-Sheldon syndrome; Frontometaphyseal dysplasia land 3; Frontotemporal dementia; Frontotemporal dementia and/or amyotrophic lateral sclerosis 3 and 4; Frontotemporal Dementia Chromosome 3-Linked and Frontotemporal dementia ubiquitin-positive; Fructose-bisphosphatase deficiency; Fuhrmann syndrome; Gamma-aminobutyric acid transaminase deficiency; Gamstorp-Wohlfart syndrome; Gaucher disease type 1 and Subacute neuronopathic; Gaze palsy, familial horizontal, with progressive scoliosis; Generalized dominant dystrophic epidermolysis bullosa; Generalized epilepsy with febrile seizures plus 3, type 1, type 2; Epileptic encephalopathy Lennox-Gastaut type; Giant axonal neuropathy; Glanzmann thrombasthenia; Glaucoma 1, open angle, e, F, and G; Glaucoma 3, primary congenital, d; Glaucoma, congenital and Glaucoma, congenital, Coloboma; Glaucoma, primary open angle, juvenile-onset; Glioma susceptibility 1; Glucose transporter type 1 deficiency syndrome; Glucose-6-phosphate transport defect; GLUT1 deficiency syndrome 2; Epilepsy, idiopathic generalized, susceptibility to, 12; Glutamate formiminotransferase deficiency; Glutaric acidemia IIA and IIB; Glutaric aciduria, type 1; Gluthathione synthetase deficiency; Glycogen storage disease 0 (muscle), II (adult form), IXa2, IXc, type 1A; type II, type IV, IV (combined hepatic and myopathic), type V, and type VI; Goldmann-Favre syndrome; Gordon syndrome; Gorlin syndrome; Holoprosencephaly sequence; Holoprosencephaly 7; Granulomatous disease, chronic, X-linked, variant; Granulosa cell tumor of the ovary; Gray platelet syndrome; Griscelli syndrome type 3; Groenouw corneal dystrophy type I; Growth and mental retardation, mandibulofacial dysostosis, microcephaly, and cleft palate; Growth hormone deficiency with pituitary anomalies; Growth hormone insensitivity with immunodeficiency; GTP cyclohydrolase I deficiency; Hajdu-Cheney syndrome; Hand foot uterus syndrome; Hearing impairment; Hemangioma, capillary infantile; Hematologic neoplasm; Hemochromatosis type 1, 2B, and 3; Microvascular complications of diabetes 7; Transferrin serum level quantitative trait locus 2; Hemoglobin H disease, nondeletional; Hemolytic anemia, nonspherocytic, due to glucose phosphate isomerase deficiency; Hemophagocytic lymphohistiocytosis, familial, 2; Hemophagocytic lymphohistiocytosis, familial, 3; Heparin cofactor II deficiency; Hereditary acrodermatitis enteropathica; Hereditary breast and ovarian cancer syndrome; Ataxia-telangiectasia-like disorder; Hereditary diffuse gastric cancer; Hereditary diffuse leukoencephalopathy with spheroids; Hereditary factors II, IX, VIII deficiency disease; Hereditary hemorrhagic telangiectasia type 2; Hereditary insensitivity to pain with anhidrosis; Hereditary lymphedema type I; Hereditary motor and sensory neuropathy with optic atrophy; Hereditary myopathy with early respiratory failure; Hereditary neuralgic amyotrophy; Hereditary Nonpolyposis Colorectal Neoplasms; Lynch syndrome I and II; Hereditary pancreatitis; Pancreatitis, chronic, susceptibility to; Hereditary sensory and autonomic neuropathy type IIB and IIA; Hereditary sideroblastic anemia; Hermansky- Pudlak syndrome 1, 3, 4, and 6; Heterotaxy, visceral, 2, 4, and 6, autosomal; Heterotaxy, visceral, X-linked; Heterotopia; Histiocytic medullary reticulosis; Histiocytosis-lymphadenopathy plus syndrome; Holocarboxylase synthetase deficiency; Holoprosencephaly 2, 3, 7, and 9; Holt-Oram syndrome; Homocysteinemia due to MTHFR deficiency, CBS deficiency, and Homocystinuria, pyridoxine-responsive; Homocystinuria-Megaloblastic anemia due to defect in cobalamin metabolism, cb1E complementation type; Howel-Evans syndrome; Hurler syndrome; Hutchinson-Gilford syndrome; Hydrocephalus; Hyperammonemia, type III; Hypercholesterolaemia and Hypercholesterolemia, autosomal recessive; Hyperekplexia 2 and Hyperekplexia hereditary; Hyperferritinemia cataract syndrome; Hyperglycinuria; Hyperimmunoglobulin D with periodic fever; Mevalonic aciduria; Hyperimmunoglobulin E syndrome; Hyperinsulinemic hypoglycemia familial 3, 4, and 5; Hyperinsulinism-hyperammonemia syndrome; Hyperlysinemia; Hypermanganesemia with dystonia, polycythemia and cirrhosis; Hyperornithinemia-hyperammonemia-homocitrullinuria syndrome; Hyperparathyroidism 1 and 2; Hyperparathyroidism, neonatal severe; Hyperphenylalaninemia, bh4-deficient, a, due to partial pts deficiency, BH4-deficient, D, and non-pku; Hypophosphatasia with mental retardation syndrome 2, 3, and 4; Hypertrichotic osteochondrodysplasia; Hypobetalipoproteinemia, familial, associated with apob32; Hypocalcemia, autosomal dominant 1; Hypocalciuric hypercalcemia, familial, types 1 and 3; Hypochondrogenesis; Hypochromic microcytic anemia with iron overload; Hypoglycemia with deficiency of glycogen synthetase in the liver; Hypogonadotropic hypogonadism 11 with or without anosmia; Hypohidrotic ectodermal dysplasia with immune deficiency; Hypohidrotic X-linked ectodermal dysplasia; Hypokalemic periodic paralysis 1 and 2; Hypomagnesemia 1, intestinal; Hypomagnesemia, seizures, and mental retardation; Hypomyelinating leukodystrophy 7; Hypoplastic left heart syndrome; Atrioventricular septal defect and common atrioventricular junction; Hypospadias 1 and 2, X-linked; Hypothyroidism, congenital, nongoitrous, 1; Hypotrichosis 8 and 12; Hypotrichosis-lymphedema-telangiectasia syndrome; I blood group system; Ichthyosis bullosa of Siemens; Ichthyosis exfoliativa; Ichthyosis prematurity syndrome; Idiopathic basal ganglia calcification 5; Idiopathic fibrosing alveolitis, chronic form; Dyskeratosis congenita, autosomal dominant, 2 and 5; Idiopathic hypercalcemia of infancy; Immune dysfunction with T-cell inactivation due to calcium entry defect 2; Immunodeficiency 15, 16, 19, 30, 31C, 38, 40, 8, due to defect in cd3-zeta, with hyper IgM type 1 and 2, and X-Linked, with magnesium defect, Epstein-Barr virus infection, and neoplasia; Immunodeficiency-centromeric instability-facial anomalies syndrome 2; Inclusion body myopathy 2 and 3; Nonaka myopathy; Infantile convulsions and paroxysmal choreoathetosis, familial; Infantile cortical hyperostosis; Infantile GM1 gangliosidosis; Infantile hypophosphatasia; Infantile nephronophthisis; Infantile nystagmus, X-linked; Infantile Parkinsonism-dystonia; Infertility associated with multi-tailed spermatozoa and excessive DNA; Insulin resistance; Insulin-resistant diabetes mellitus and acanthosis nigricans; Insulin-dependent diabetes mellitus secretory diarrhea syndrome; Interstitial nephritis, karyomegalic; Intrauterine growth retardation, metaphyseal dysplasia, adrenal hypoplasia congenita, and genital anomalies; Iodotyrosyl coupling defect; IRAK4 deficiency; Iridogoniodysgenesis dominant type and type 1; Iron accumulation in brain; Ischiopatellar dysplasia; Islet cell hyperplasia; Isolated 17,20-lyase deficiency; Isolated lutropin deficiency; Isovaleryl-CoA dehydrogenase deficiency; Jankovic Rivera syndrome; Jervell and Lange-Nielsen syndrome 2; Joubert syndrome 1, 6, 7, 9/15 (digenic), 14, 16, and 17, and Orofaciodigital syndrome xiv; Junctional epidermolysis bullosa gravis of Herlitz; Juvenile GM>1<gangliosidosis; Juvenile polyposis syndrome; Juvenile polyposis/hereditary hemorrhagic telangiectasia syndrome; Juvenile retinoschisis; Kabuki make-up syndrome; Kallmann syndrome 1, 2, and 6; Delayed puberty; Kanzaki disease; Karak syndrome; Kartagener syndrome; Kenny-Caffey syndrome type 2; Keppen-Lubinsky syndrome; Keratoconus 1; Keratosis follicularis; Keratosis palmoplantaris striata 1; Kindler syndrome; L-2-hydroxyglutaric aciduria; Larsen syndrome, dominant type; Lattice corneal dystrophy Type III; Leber amaurosis; Zellweger syndrome; Peroxisome biogenesis disorders; Zellweger syndrome spectrum; Leber congenital amaurosis 11, 12, 13, 16, 4, 7, and 9; Leber optic atrophy; Aminoglycoside-induced deafness; Deafness, nonsyndromic sensorineural, mitochondrial; Left ventricular noncompaction 5; Left-right axis malformations; Leigh disease; Mitochondrial short-chain Enoyl-CoA Hydratase 1 deficiency; Leigh syndrome due to mitochondrial complex I deficiency; Leiner disease; Leri Weill dyschondrosteosis; Lethal congenital contracture syndrome 6; Leukocyte adhesion deficiency type I and III; Leukodystrophy, Hypomyelinating, 11 and 6; Leukoencephalopathy with ataxia, with Brainstem and Spinal Cord Involvement and Lactate Elevation, with vanishing white matter, and progressive, with ovarian failure; Leukonychia totalis; Lewy body dementia; Lichtenstein-Knorr Syndrome; Li-Fraumeni syndrome 1; Lig4 syndrome; Limb-girdle muscular dystrophy, type 1B, 2A, 2B, 2D, C1, C5, C9, C14; Congenital muscular dystrophy-dystroglycanopathy with brain and eye anomalies, type A14 and B14; Lipase deficiency combined; Lipid proteinosis; Lipodystrophy, familial partial, type 2 and 3; Lissencephaly 1, 2 (X-linked), 3, 6 (with microcephaly), X-linked; Subcortical laminar heterotopia, X-linked; Liver failure acute infantile; Loeys-Dietz syndrome 1, 2, 3; Long QT syndrome 1, 2, 2/9, 2/5, (digenic), 3, 5 and 5, acquired, susceptibility to; Lung cancer; Lymphedema, hereditary, id; Lymphedema, primary, with myelodysplasia; Lymphoproliferative syndrome 1, 1 (X-linked), and 2; Lysosomal acid lipase deficiency; Macrocephaly, macrosomia, facial dysmorphism syndrome; Macular dystrophy, vitelliform, adult-onset; Malignant hyperthermia susceptibility type 1; Malignant lymphoma, non-Hodgkin; Malignant melanoma; Malignant tumor of prostate; Mandibuloacral dysostosis; Mandibuloacral dysplasia with type A or B lipodystrophy, atypical; Mandibulofacial dysostosis, Treacher Collins type, autosomal recessive; Mannose-binding protein deficiency; Maple syrup urine disease type 1A and type 3; Marden Walker like syndrome; Marfan syndrome; Marinesco-Sj\xc3\xb6gren syndrome; Martsolf syndrome; Maturity-onset diabetes of the young, type 1, type 2, type 11, type 3, and type 9; May-Hegglin anomaly; MYH9 related disorders; Sebastian syndrome; McCune-Albright syndrome; Somatotroph adenoma; Sex cord-stromal tumor; Cushing syndrome; McKusick Kaufman syndrome; McLeod neuroacanthocytosis syndrome; Meckel-Gruber syndrome; Medium-chain acyl-coenzyme A dehydrogenase deficiency; Medulloblastoma; Megalocephalic leukoencephalopathy with subcortical cysts land 2a; Megalocephaly cutis marmorata telangiectatica congenital; PIK3CA Related Overgrowth Spectrum; Megalencephaly-polymicrogyria-polydactyly-hydrocephalus syndrome 2; Megaloblastic anemia, thiamine-responsive, with diabetes mellitus and sensorineural deafness; Meier-Gorlin syndromes land 4; Melnick-Needles syndrome; Meningioma; Mental retardation, X-linked, 3, 21, 30, and 72; Mental retardation and microcephaly with pontine and cerebellar hypoplasia; Mental retardation X-linked syndromic 5; Mental retardation, anterior maxillary protrusion, and strabismus; Mental retardation, autosomal dominant 12, 13, 15, 24, 3, 30, 4, 5, 6, and 9; Mental retardation, autosomal recessive 15, 44, 46, and 5; Mental retardation, stereotypic movements, epilepsy, and/or cerebral malformations; Mental retardation, syndromic, Claes-Jensen type, X-linked; Mental retardation, X-linked, nonspecific, syndromic, *Hedera* type, and syndromic, wu type; Merosin deficient congenital muscular dystrophy; Metachromatic leukodystrophy juvenile, late infantile, and adult types; Metachromatic leukodystrophy; Metatrophic dysplasia; Methemoglobinemia types I and 2; Methionine adenosyltransferase deficiency, autosomal dominant; Methylmalonic acidemia with homocystinuria, Methylmalonic aciduria cb1B type, Methylmalonic aciduria due to methylmalonyl-CoA mutase deficiency; METHYLMALONIC ACIDURIA, mut(0) TYPE; Microcephalic osteodysplastic primordial dwarfism type 2; Microcephaly with or without chorioretinopathy, lymphedema, or mental retardation; Microcephaly, hiatal hernia and nephrotic syndrome; Microcephaly; Hypoplasia of the corpus callosum; Spastic paraplegia 50, autosomal recessive; Global developmental delay; CNS hypomyelination; Brain atrophy; Microcephaly, normal intelligence and immunodeficiency; Microcephaly-capillary malformation syndrome; Microcytic anemia; Microphthalmia syndromic 5, 7, and 9; Microphthalmia, isolated 3, 5, 6, 8, and with coloboma 6; Microspherophakia; Migraine, familial basilar; Miller syndrome; Minicore myopathy with external ophthalmoplegia; Myopathy, congenital with cores; Mitchell-Riley syndrome; mitochondrial 3-hydroxy-3-methylglutaryl-CoA synthase deficiency; Mitochondrial complex I, II, III, III (nuclear type 2, 4, or 8) deficiency; Mitochondrial DNA depletion syndrome 11, 12 (cardiomyopathic type), 2, 4B (MNGIE type), 8B (MNGIE type); Mitochondrial DNA-depletion syndrome 3 and 7, hepatocerebral types, and 13 (encephalomyopathic type); Mitochondrial phosphate carrier and pyruvate carrier deficiency; Mitochondrial trifunctional protein deficiency; Long-chain 3-hydroxyacyl-CoA dehydrogenase deficiency; Miyoshi muscular dystrophy 1; Myopathy, distal, with anterior tibial onset; Mohr-Tranebjaerg syndrome; Molybdenum cofactor deficiency, complementation group A; Mowat-Wilson syndrome; Mucolipidosis III Gamma; Mucopolysaccharidosis type VI, type VI (severe), and type VII; Mucopolysaccharidosis, MPS-I-H/S, MPS-II, MPS-III-A, MPS-III-B, MPS-III-C, MPS-IV-A, MPS-IV-B; Retinitis Pigmentosa 73; Gangliosidosis GM1 type1 (with cardiac involvement) 3; Multicentric osteolysis nephropathy; Multicentric osteolysis, nodulosis and arthropathy; Multiple congenital anomalies; Atrial septal defect 2; Multiple congenital anomalies-hypotonia-seizures syndrome 3; Multiple Cutaneous and Mucosal Venous Malformations; Multiple endocrine neoplasia, types 1and 4; Multiple epiphyseal dysplasia 5 or Dominant; Multiple gastrointestinal atresias; Multiple pterygium syndrome Escobar type; Multiple sulfatase deficiency; Multiple synostoses syndrome 3; Muscle AMP deaminase deficiency; Muscle eye brain disease; Muscular dystrophy, congenital, megaconial type; Myasthenia, familial infantile, 1; Myasthenic Syndrome, Congenital, 11, associated with acetylcholine receptor deficiency; Myasthenic Syndrome, Congenital, 17, 2A (slow-channel), 4B (fast-channel), and without tubular aggregates; Myeloperoxidase deficiency; MYH-associated polyposis; Endometrial carcinoma; Myocardial infarction 1; Myoclonic dystonia; Myoclonic-Atonic Epilepsy; Myoclonus with epilepsy with ragged red fibers; Myofibrillar myopathy 1 and ZASP-related; Myoglobinuria, acute recurrent, autosomal recessive; Myoneural gastrointestinal encephalopathy syndrome; Cerebellar ataxia infantile with progressive external ophthalmoplegia; Mitochondrial DNA depletion syndrome 4B, MNGIE type; Myopathy, centronuclear, 1, congenital, with excess of muscle spindles, distal, 1, lactic acidosis, and sideroblastic anemia 1, mitochondrial progressive with congenital cataract, hearing loss, and developmental delay, and tubular aggregate, 2; Myopia 6; Myosclerosis, autosomal recessive; Myotonia congenital; Congenital myotonia, autosomal dominant and recessive forms; Nail-patella syndrome; Nance-Horan syndrome; Nanophthalmos 2; Navajo neurohepatopathy; Nemaline myopathy 3 and 9; Neonatal hypotonia; Intellectual disability; Seizures; Delayed speech and language development; Mental retardation, autosomal dominant 31; Neonatal intrahepatic cholestasis caused by citrin deficiency; Nephrogenic diabetes insipidus, Nephrogenic diabetes insipidus, X-linked; Nephrolithiasis/osteoporosis, hypophosphatemic, 2; Nephronophthisis 13, 15 and 4; Infertility; Cerebello-oculo-renal syndrome (nephronophthisis, oculomotor apraxia and cerebellar abnormalities); Nephrotic syndrome, type 3, type 5, with or without ocular abnormalities, type 7, and type 9; Nestor-Guillermo progeria syndrome; Neu-Laxova syndrome 1; Neurodegeneration with brain iron accumulation 4 and 6; Neuroferritinopathy; Neurofibromatosis, type 1and type 2; Neurofibrosarcoma; Neurohypophyseal diabetes insipidus; Neuropathy, Hereditary Sensory, Type IC; Neutral 1 amino acid transport defect; Neutral lipid storage disease with myopathy; Neutrophil immunodeficiency syndrome; Nicolaides-Baraitser syndrome; Niemann-Pick disease type C1, C2, type A, and type C1, adult form; Non-ketotic hyperglycinemia; Noonan syndrome 1 and 4, LEOPARD syndrome 1; Noonan syndrome-like disorder with or without juvenile myelomonocytic leukemia; Normokalemic periodic paralysis, potassium-sensitive; Norum disease; Epilepsy, Hearing Loss, And Mental Retardation Syndrome; Mental Retardation, X-Linked 102 and syndromic 13; Obesity; Ocular albinism, type I; Oculocutaneous albinism type 1B, type 3, and type 4; Oculodentodigital dysplasia; Odontohypophosphatasia; Odontotrichomelic syndrome; Oguchi disease; Oligodontia-colorectal cancer syndrome; Opitz G/BBB syndrome; Optic atrophy 9; Oral-facial-digital syndrome; Ornithine aminotransferase deficiency; Orofacial cleft 11 and 7, Cleft lip/palate-ectodermal dysplasia syndrome; Orstavik Lindemann Solberg syndrome; Osteoarthritis with mild chondrodysplasia; Osteochondritis dissecans; Osteogenesis imperfecta type 12, type 5, type 7, type 8, type I, type III, with normal sclerae, dominant form, recessive perinatal lethal; Osteopathia striata with cranial sclerosis; Osteopetrosis autosomal dominant type 1 and 2, recessive 4, recessive 1, recessive 6; Osteoporosis with pseudoglioma; Oto-palato-digital syndrome, types I and II; Ovarian dysgenesis 1; Ovarioleukodystrophy; Pachyonychia congenita 4 and type 2; Paget disease of bone, familial; Pallister-Hall syndrome; Palmoplantar keratoderma, nonepidermolytic, focal or diffuse; Pancreatic agenesis and congenital heart disease; Papillon-Lef\xc3\xa8vre syndrome; Paragangliomas 3; Paramyotonia congenita of von Eulenburg; Parathyroid carcinoma; Parkinson disease 14, 15, 19 (juvenile-onset), 2, 20 (early-onset), 6, (autosomal recessive early-onset, and 9; Partial albinism; Partial hypoxanthine-guanine phosphoribosyltransferase deficiency; Patterned dystrophy of retinal pigment epithelium; PC-K6a; Pelizaeus-Merzbacher disease; Pendred syndrome; Peripheral demyelinating neuropathy, central dysmyelination; Hirschsprung disease; Permanent neonatal diabetes mellitus; Diabetes mellitus, permanent neonatal, with neurologic features; Neonatal insulin-dependent diabetes mellitus; Maturity-onset diabetes of the young, type 2; Peroxisome biogenesis disorder 14B, 2A, 4A, 5B, 6A, 7A, and 7B; Perrault syndrome 4; Perry syndrome; Persistent hyperinsulinemic hypoglycemia of infancy; familial hyperinsulinism; Phenotypes; Phenylketonuria; Pheochromocytoma; Hereditary Paraganglioma-Pheochromocytoma Syndromes; Paragangliomas 1; Carcinoid tumor of intestine; Cowden syndrome 3; Phosphoglycerate dehydrogenase deficiency; Phosphoglycerate kinase 1 deficiency; Photosensitive trichothiodystrophy; Phytanic acid storage disease; Pick disease; Pierson syndrome; Pigmentary retinal dystrophy; Pigmented nodular adrenocortical disease, primary, 1; Pilomatrixoma; Pitt-Hopkins syndrome; Pituitary dependent hypercortisolism; Pituitary hormone deficiency, combined 1, 2, 3, and 4; Plasminogen activator inhibitor type 1 deficiency; Plasminogen deficiency, type I; Platelet-type bleeding disorder 15 and 8; Poikiloderma, hereditary fibrosing, with tendon contractures, myopathy, and pulmonary fibrosis; Polycystic kidney disease 2, adult type, and infantile type; Polycystic lipomembranous osteodysplasia with sclerosing leukoencephalopathy; Polyglucosan body myopathy 1 with or without immunodeficiency; Polymicrogyria, asymmetric, bilateral frontoparietal; Polyneuropathy, hearing loss, ataxia, retinitis pigmentosa, and cataract; Pontocerebellar hypoplasia type 4; Popliteal pterygium syndrome; Porencephaly 2; Porokeratosis 8, disseminated superficial actinic type; Porphobilinogen synthase deficiency; *Porphyria cutanea* tarda; Posterior column ataxia with retinitis pigmentosa; Posterior polar cataract type 2; Prader-Willi-like syndrome; Premature ovarian failure 4, 5, 7, and 9; Primary autosomal recessive microcephaly 10, 2, 3, and 5; Primary ciliary dyskinesia 24; Primary dilated cardiomyopathy; Left ventricular noncompaction 6; 4, Left ventricular noncompaction 10; Paroxysmal atrial fibrillation; Primary hyperoxaluria, type I, type, and type III; Primary hypertrophic osteoarthropathy, autosomal recessive 2; Primary hypomagnesemia; Primary open angle glaucoma juvenile onset 1; Primary pulmonary hypertension; Primrose syndrome; Progressive familial heart block type 1B; Progressive familial intrahepatic cholestasis 2 and 3; Progressive intrahepatic cholestasis; Progressive myoclonus epilepsy with ataxia; Progressive pseudorheumatoid dysplasia; Progressive sclerosing poliodystrophy; Prolidase deficiency; Proline dehydrogenase deficiency; Schizophrenia 4; Properdin deficiency, X-linked; Propionic academia; Proprotein convertase ⅓ deficiency; Prostate cancer, hereditary, 2; Protan defect; Proteinuria; Finnish congenital nephrotic syndrome; *Proteus* syndrome; Breast adenocarcinoma; Pseudoachondroplastic spondyloepiphysial dysplasia syndrome; Pseudohypoaldosteronism type 1 autosomal dominant and recessive and type 2; Pseudohypoparathyroidism type 1A, Pseudopseudohypoparathyroidism; Pseudoneonatal adrenoleukodystrophy; Pseudoprimary hyperaldosteronism; Pseudoxanthoma elasticum; Generalized arterial calcification of infancy 2; Pseudoxanthoma elasticum-like disorder with multiple coagulation factor deficiency; Psoriasis susceptibility 2; PTEN hamartoma tumor syndrome; Pulmonary arterial hypertension related to hereditary hemorrhagic telangiectasia; Pulmonary Fibrosis And/Or Bone Marrow Failure, Telomere-Related, 1 and 3; Pulmonary hypertension, primary, 1, with hereditary hemorrhagic telangiectasia; Purine-nucleoside phosphorylase deficiency; Pyruvate carboxylase deficiency; Pyruvate dehydrogenase E1-alpha deficiency; Pyruvate kinase deficiency of red cells; Raine syndrome; Rasopathy; Recessive dystrophic epidermolysis bullosa; Nail disorder, nonsyndromic congenital, 8; Reifenstein syndrome; Renal adysplasia; Renal carnitine transport defect; Renal coloboma syndrome; Renal dysplasia; Renal dysplasia, retinal pigmentary dystrophy, cerebellar ataxia and skeletal dysplasia; Renal tubular acidosis, distal, autosomal recessive, with late-onset sensorineural hearing loss, or with hemolytic anemia; Renal tubular acidosis, proximal, with ocular abnormalities and mental retardation; Retinal cone dystrophy 3B; Retinitis pigmentosa; Retinitis pigmentosa 10, 11, 12, 14, 15, 17, and 19; Retinitis pigmentosa 2, 20, 25, 35, 36, 38, 39, 4, 40, 43, 45, 48, 66, 7, 70, 72; Retinoblastoma; Rett disorder; Rhabdoid tumor predisposition syndrome 2; Rhegmatogenous retinal detachment, autosomal dominant; Rhizomelic chondrodysplasia *punctata* type 2 and type 3; Roberts-SC phocomelia syndrome; Robinow Sorauf syndrome; Robinow syndrome, autosomal recessive, autosomal recessive, with brachy-syn-polydactyly; Rothmund-Thomson syndrome; Rapadilino syndrome; RRM2B-related mitochondrial disease; Rubinstein-Taybi syndrome; Salla disease; Sandhoff disease, adult and infantil types; Sarcoidosis, early-onset; Blau syndrome; Schindler disease, type 1; Schizencephaly; Schizophrenia 15; Schneckenbecken dysplasia; Schwannomatosis 2; Schwartz Jampel syndrome type 1; Sclerocornea, autosomal recessive; Sclerosteosis; Secondary hypothyroidism; Segawa syndrome, autosomal recessive; Senior-Loken syndrome 4 and 5, Sensory ataxic neuropathy, dysarthria, and ophthalmoparesis; Sepiapterin reductase deficiency; SeSAME syndrome; Severe combined immunodeficiency due to ADA deficiency, with microcephaly, growth retardation, and sensitivity to ionizing radiation, atypical, autosomal recessive, T cell-negative, B cell-positive, NK cell-negative of NK-positive; Partial adenosine deaminase deficiency; Severe congenital neutropenia; Severe congenital neutropenia 3, autosomal recessive or dominant; Severe congenital neutropenia and 6, autosomal recessive; Severe myoclonic epilepsy in infancy; Generalized epilepsy with febrile seizures plus, types 1 and 2; Severe X-linked myotubular myopathy; Short QT syndrome 3; Short stature with nonspecific skeletal abnormalities; Short stature, auditory canal atresia, mandibular hypoplasia, skeletal abnormalities; Short stature, onychodysplasia, facial dysmorphism, and hypotrichosis; Primordial dwarfism; Short-rib thoracic dysplasia 11 or 3 with or without polydactyly; Sialidosis type I and II; Silver spastic paraplegia syndrome; Slowed nerve conduction velocity, autosomal dominant; Smith-Lemli-Opitz syndrome; Snyder Robinson syndrome; Somatotroph adenoma; Prolactinoma; familial, Pituitary adenoma predisposition; Sotos syndrome 1 or 2; Spastic ataxia 5, autosomal recessive, Charlevoix-Saguenay type, 1, 10, or 11, autosomal recessive; Amyotrophic lateral sclerosis type 5; Spastic paraplegia 15, 2, 3, 35, 39, 4, autosomal dominant, 55, autosomal recessive, and 5A; Bile acid synthesis defect, congenital, 3; Spermatogenic failure 11, 3, and 8; Spherocytosis types 4 and 5; Spheroid body myopathy; Spinal muscular atrophy, lower extremity predominant 2, autosomal dominant; Spinal muscular atrophy, type II; Spinocerebellar ataxia 14, 21, 35, 40, and 6; Spinocerebellar ataxia autosomal recessive 1 and 16; Splenic hypoplasia; Spondylocarpotarsal synostosis syndrome; Spondylocheirodysplasia, Ehlers-Danlos syndrome-like, with immune dysregulation, Aggrecan type, with congenital joint dislocations, short limb-hand type, Sedaghatian type, with cone-rod dystrophy, and Kozlowski type; Parastremmatic dwarfism; Stargardt disease 1; Cone-rod dystrophy 3; Stickler syndrome type 1; Kniest dysplasia; Stickler syndrome, types 1 (nonsyndromic ocular) and 4; Sting-associated vasculopathy, infantile-onset; Stormorken syndrome; Sturge-Weber syndrome, Capillary malformations, congenital, 1; Succinyl-CoA acetoacetate transferase deficiency; Sucrase-isomaltase deficiency; Sudden infant death syndrome; Sulfite oxidase deficiency, isolated; Supravalvar aortic stenosis; Surfactant metabolism dysfunction, pulmonary, 2 and 3; Symphalangism, proximal, 1b; Syndactyly Cenani Lenz type; Syndactyly type 3; Syndromic X-linked mental retardation 16; Talipes equinovarus; Tangier disease; TARP syndrome; Tay-Sachs disease, B1 variant, Gm2-gangliosidosis (adult), Gm2-gangliosidosis (adult-onset); Temtamy syndrome; Tenorio Syndrome; Terminal osseous dysplasia; Testosterone 17-beta-dehydrogenase deficiency; Tetraamelia, autosomal recessive; Tetralogy of Fallot; Hypoplastic left heart syndrome 2; Truncus arteriosus; Malformation of the heart and great vessels; Ventricular septal defect 1; Thiel-Behnke corneal dystrophy; Thoracic aortic aneurysms and aortic dissections; Marfanoid habitus; Three M syndrome 2; Thrombocytopenia, platelet dysfunction, hemolysis, and imbalanced globin synthesis; Thrombocytopenia, X-linked; Thrombophilia, hereditary, due to protein C deficiency, autosomal dominant and recessive; Thyroid agenesis; Thyroid cancer, follicular; Thyroid hormone metabolism, abnormal; Thyroid hormone resistance, generalized, autosomal dominant; Thyrotoxic periodic paralysis and Thyrotoxic periodic paralysis 2; Thyrotropin-releasing hormone resistance, generalized; Timothy syndrome; TNF receptor-associated periodic fever syndrome (TRAPS); Tooth agenesis, selective, 3 and 4; Torsades de pointes; Townes-Brocks-branchiootorenal-like syndrome; Transient bullous dermolysis of the newborn; Treacher collins syndrome 1; Trichomegaly with mental retardation, dwarfism and pigmentary degeneration of retina; Trichorhinophalangeal dysplasia type I; Trichorhinophalangeal syndrome type 3; Trimethylaminuria; Tuberous sclerosis syndrome; Lymphangiomyomatosis; Tuberous sclerosis 1 and 2; Tyrosinase-negative oculocutaneous albinism; Tyrosinase-positive oculocutaneous albinism; Tyrosinemia type I; UDPglucose-4-epimerase deficiency; Ullrich congenital muscular dystrophy; Ulna and fibula absence of with severe limb deficiency; Upshaw-Schulman syndrome; Urocanate hydratase deficiency; Usher syndrome, types 1, 1B, 1D, 1G, 2A, 2C, and 2D; Retinitis pigmentosa 39; UV-sensitive syndrome; Van der Woude syndrome; Van Maldergem syndrome 2; Hennekam lymphangiectasia-lymphedema syndrome 2; Variegate *porphyria*; Ventriculomegaly with cystic kidney disease; Verheij syndrome; Very long chain acyl-CoA dehydrogenase deficiency; Vesicoureteral reflux 8; Visceral heterotaxy 5, autosomal; Visceral myopathy; Vitamin D-dependent rickets, types 1and 2; Vitelliform dystrophy; von Willebrand disease type 2M and type 3; Waardenburg syndrome type 1, 4C, and 2E (with neurologic involvement); Klein-Waardenberg syndrome; Walker-Warburg congenital muscular dystrophy; Warburg micro syndrome 2 and 4; Warts, hypogammaglobulinemia, infections, and myelokathexis; Weaver syndrome; Weill-Marchesani syndrome 1 and 3; Weill-Marchesani-like syndrome; Weissenbacher-Zweymuller syndrome; Werdnig-Hoffmann disease; Charcot-Marie-Tooth disease; Werner syndrome; WFS1-Related Disorders; Wiedemann-Steiner syndrome; Wilson disease; Wolfram-like syndrome, autosomal dominant; Worth disease; Van Buchem disease type 2; Xeroderma pigmentosum, complementation group b, group D, group E, and group G; X-linked agammaglobulinemia; X-linked hereditary motor and sensory neuropathy; X-linked ichthyosis with stearyl-sulfatase deficiency; X-linked periventricular heterotopia; Oto-palato-digital syndrome, type I; X-linked severe combined immunodeficiency; Zimmermann-Laband syndrome and Zimmermann-Laband syndrome 2; and Zonular pulverulent cataract 3.

The instant disclosure provides lists of genes comprising pathogenic G to A or C to T mutations. Such pathogenic G to A or C to T mutations may be corrected using the methods and compositions provided herein, for example by mutating the A to a G, and/or the T to a C, thereby restoring gene function. Table 2 includes exemplary mutations that can be corrected using base editors described herein. Table 2 includes the gene symbol, the associated phenotype, the mutation to be corrected and exemplary gRNA sequences which may be used to correct the mutations. The gRNA sequences provided in Table 2 are sequences that encode RNA that can direct Cas9, or any of the base editors provided herein, to a target site. For example, the gRNA sequences provided in Table 2 may be cloned into a gRNA expression vector, such as pFYF to encode a gRNA that targets Cas9, or any of the base editors provided herein, to a target site in order to correct a disease-related mutation. It should be appreciated, however, that additional mutations may be corrected to treat additional diseases associated with a G to A or C to T mutation. Furthermore, additional gRNAs may be designed based on the disclosure and the knowledge in the art, which would be appreciated by the skilled artisan.

Pharmaceutical Compositions

Other aspects of the present disclosure relate to pharmaceutical compositions comprising any of the adenosine deaminases, fusion proteins, or the fusion protein-gRNA complexes described herein. The term "pharmaceutical composition", as used herein, refers to a composition formulated for pharmaceutical use. In some embodiments, the pharmaceutical composition further comprises a pharmaceutically acceptable carrier. In some embodiments, the pharmaceutical composition comprises additional agents (e.g. for specific delivery, increasing half-life, or other therapeutic compounds).

As used here, the term "pharmaceutically-acceptable carrier" means a pharmaceutically-acceptable material, composition or vehicle, such as a liquid or solid filler, diluent, excipient, manufacturing aid (e.g., lubricant, talc magnesium, calcium or zinc stearate, or steric acid), or solvent encapsulating material, involved in carrying or transporting the compound from one site (e.g., the delivery site) of the body, to another site (e.g., organ, tissue or portion of the body). A pharmaceutically acceptable carrier is "acceptable" in the sense of being compatible with the other ingredients of the formulation and not injurious to the tissue of the subject (e.g., physiologically compatible, sterile, physiologic pH, etc.). Some examples of materials which can serve as pharmaceutically-acceptable carriers include: (1) sugars, such as lactose, glucose and sucrose; (2) starches, such as corn starch and potato starch; (3) cellulose, and its derivatives, such as sodium carboxymethyl cellulose, methylcellulose, ethyl cellulose, microcrystalline cellulose and cellulose acetate; (4) powdered tragacanth; (5) malt; (6) gelatin; (7) lubricating agents, such as magnesium stearate, sodium lauryl sulfate and talc; (8) excipients, such as cocoa butter and suppository waxes; (9) oils, such as peanut oil, cottonseed oil, safflower oil, sesame oil, olive oil, corn oil and soybean oil; (10) glycols, such as propylene glycol; (11) polyols, such as glycerin, sorbitol, mannitol and polyethylene glycol (PEG); (12) esters, such as ethyl oleate and ethyl laurate; (13) agar; (14) buffering agents, such as magnesium hydroxide and aluminum hydroxide; (15) alginic acid; (16)

pyrogen-free water; (17) isotonic saline; (18) Ringer's solution; (19) ethyl alcohol; (20) pH buffered solutions; (21) polyesters, polycarbonates and/or polyanhydrides; (22) bulking agents, such as polypeptides and amino acids (23) serum component, such as serum albumin, HDL and LDL; (22) C2-C12 alcohols, such as ethanol; and (23) other non-toxic compatible substances employed in pharmaceutical formulations. Wetting agents, coloring agents, release agents, coating agents, sweetening agents, flavoring agents, perfuming agents, preservative and antioxidants can also be present in the formulation. The terms such as "excipient", "carrier", "pharmaceutically acceptable carrier" or the like are used interchangeably herein.

In some embodiments, the pharmaceutical composition is formulated for delivery to a subject, e.g., for gene editing. Suitable routes of administrating the pharmaceutical composition described herein include, without limitation: topical, subcutaneous, transdermal, intradermal, intralesional, intraarticular, intraperitoneal, intravesical, transmucosal, gingival, intradental, intracochlear, transtympanic, intraorgan, epidural, intrathecal, intramuscular, intravenous, intravascular, intraosseous, periocular, intratumoral, intracerebral, and intracerebroventricular administration.

In some embodiments, the pharmaceutical composition described herein is administered locally to a diseased site (e.g., tumor site). In some embodiments, the pharmaceutical composition described herein is administered to a subject by injection, by means of a catheter, by means of a suppository, or by means of an implant, the implant being of a porous, non-porous, or gelatinous material, including a membrane, such as a sialastic membrane, or a fiber.

In other embodiments, the pharmaceutical composition described herein is delivered in a controlled release system. In one embodiment, a pump may be used (see, e.g., Langer, 1990, Science 249:1527-1533; Sefton, 1989, CRC Crit. Ref. Biomed. Eng. 14:201; Buchwald et al., 1980, Surgery 88:507; Saudek et al., 1989, N. Engl. J. Med. 321:574). In another embodiment, polymeric materials can be used. (See, e.g., Medical Applications of Controlled Release (Langer and Wise eds., CRC Press, Boca Raton, Fla., 1974); Controlled Drug Bioavailability, Drug Product Design and Performance (Smolen and Ball eds., Wiley, New York, 1984); Ranger and Peppas, 1983, Macromol. Sci. Rev. Macromol. Chem. 23:61. See also Levy et al., 1985, Science 228:190; During et al., 1989, Ann. Neurol. 25:351; Howard et al., 1989, J. Neurosurg. 71:105.) Other controlled release systems are discussed, for example, in Langer, supra.

In some embodiments, the pharmaceutical composition is formulated in accordance with routine procedures as a composition adapted for intravenous or subcutaneous administration to a subject, e.g., a human. In some embodiments, pharmaceutical composition for administration by injection are solutions in sterile isotonic aqueous buffer. Where necessary, the pharmaceutical can also include a solubilizing agent and a local anesthetic such as lignocaine to ease pain at the site of the injection. Generally, the ingredients are supplied either separately or mixed together in unit dosage form, for example, as a dry lyophilized powder or water free concentrate in a hermetically sealed container such as an ampoule or sachette indicating the quantity of active agent. Where the pharmaceutical is to be administered by infusion, it can be dispensed with an infusion bottle containing sterile pharmaceutical grade water or saline. Where the pharmaceutical composition is administered by injection, an ampoule of sterile water for injection or saline can be provided so that the ingredients can be mixed prior to administration.

A pharmaceutical composition for systemic administration may be a liquid, e.g., sterile saline, lactated Ringer's or Hank's solution. In addition, the pharmaceutical composition can be in solid forms and re-dissolved or suspended immediately prior to use. Lyophilized forms are also contemplated.

The pharmaceutical composition can be contained within a lipid particle or vesicle, such as a liposome or microcrystal, which is also suitable for parenteral administration. The particles can be of any suitable structure, such as unilamellar or plurilamellar, so long as compositions are contained therein. Compounds can be entrapped in "stabilized plasmid-lipid particles" (SPLP) containing the fusogenic lipid dioleoylphosphatidylethanolamine (DOPE), low levels (5-10 mol %) of cationic lipid, and stabilized by a polyethyleneglycol (PEG) coating (Zhang Y. P. et al., Gene Ther. 1999, 6:1438-47). Positively charged lipids such as N-[1-(2,3-dioleoyloxi)propyl]-N,N,N-trimethyl-amoniummethylsulfate, or "DOTAP," are particularly preferred for such particles and vesicles. The preparation of such lipid particles is well known. See, e.g., U.S. Pat. Nos. 4,880,635; 4,906, 477; 4,911,928; 4,917,951; 4,920,016; and 4,921,757; each of which is incorporated herein by reference.

The pharmaceutical composition described herein may be administered or packaged as a unit dose, for example. The term "unit dose" when used in reference to a pharmaceutical composition of the present disclosure refers to physically discrete units suitable as unitary dosage for the subject, each unit containing a predetermined quantity of active material calculated to produce the desired therapeutic effect in association with the required diluent; i.e., carrier, or vehicle.

Further, the pharmaceutical composition can be provided as a pharmaceutical kit comprising (a) a container containing a compound of the invention in lyophilized form and (b) a second container containing a pharmaceutically acceptable diluent (e.g., sterile water) for injection. The pharmaceutically acceptable diluent can be used for reconstitution or dilution of the lyophilized compound of the invention. Optionally associated with such container(s) can be a notice in the form prescribed by a governmental agency regulating the manufacture, use or sale of pharmaceuticals or biological products, which notice reflects approval by the agency of manufacture, use or sale for human administration.

In another aspect, an article of manufacture containing materials useful for the treatment of the diseases described above is included. In some embodiments, the article of manufacture comprises a container and a label. Suitable containers include, for example, bottles, vials, syringes, and test tubes. The containers may be formed from a variety of materials such as glass or plastic. In some embodiments, the container holds a composition that is effective for treating a disease described herein and may have a sterile access port. For example, the container may be an intravenous solution bag or a vial having a stopper pierceable by a hypodermic injection needle. The active agent in the composition is a compound of the invention. In some embodiments, the label on or associated with the container indicates that the composition is used for treating the disease of choice. The article of manufacture may further comprise a second container comprising a pharmaceutically-acceptable buffer, such as phosphate-buffered saline, Ringer's solution, or dextrose solution. It may further include other materials desirable from a commercial and user standpoint, including other buffers, diluents, filters, needles, syringes, and package inserts with instructions for use.

Delivery Methods

In some aspects, the invention provides methods comprising delivering one or more polynucleotides, such as or one or more vectors as described herein, one or more transcripts thereof, and/or one or proteins transcribed therefrom, to a host cell. In some aspects, the invention further provides cells produced by such methods, and organisms (such as animals, plants, or fungi) comprising or produced from such cells. In some embodiments, a base editor as described herein in combination with (and optionally complexed with) a guide sequence is delivered to a cell. Conventional viral and non-viral based gene transfer methods can be used to introduce nucleic acids in mammalian cells or target tissues. Such methods can be used to administer nucleic acids encoding components of a base editor to cells in culture, or in a host organism. Non-viral vector delivery systems include DNA plasmids, RNA (e.g. a transcript of a vector described herein), naked nucleic acid, and nucleic acid complexed with a delivery vehicle, such as a liposome. Viral vector delivery systems include DNA and RNA viruses, which have either episomal or integrated genomes after delivery to the cell. For a review of gene therapy procedures, see Anderson, Science 256:808-813 (1992); Nabel & Felgner, TIBTECH 11:211-217 (1993); Mitani & Caskey, TIBTECH 11:162-166 (1993); Dillon, TIBTECH 11:167-175 (1993); Miller, Nature 357:455-460 (1992); Van Brunt, Biotechnology 6(10):1149-1154 (1988); Vigne, Restorative Neurology and Neuroscience 8:35-36 (1995); Kremer & Perricaudet, British Medical Bulletin 51(1):31-44 (1995); Haddada et al., in Current Topics in Microbiology and Immunology Doerfler and Bihm (eds) (1995); and Yu et al., Gene Therapy 1:13-26 (1994).

Methods of non-viral delivery of nucleic acids include lipofection, nucleofection, microinjection, biolistics, virosomes, liposomes, immunoliposomes, polycation or lipid:nucleic acid conjugates, naked DNA, artificial virions, and agent-enhanced uptake of DNA. Lipofection is described in e.g., U.S. Pat. Nos. 5,049,386, 4,946,787; and 4,897,355) and lipofection reagents are sold commercially (e.g., Transfectam™ and Lipofectin™). Cationic and neutral lipids that are suitable for efficient receptor-recognition lipofection of polynucleotides include those of Feigner, WO 91/17424; WO 91/16024. Delivery can be to cells (e.g. in vitro or ex vivo administration) or target tissues (e.g. in vivo administration).

The preparation of lipid:nucleic acid complexes, including targeted liposomes such as immunolipid complexes, is well known to one of skill in the art (see, e.g., Crystal, Science 270:404-410 (1995); Blaese et al., Cancer Gene Ther. 2:291-297 (1995); Behr et al., Bioconjugate Chem. 5:382-389 (1994); Remy et al., Bioconjugate Chem. 5:647-654 (1994); Gao et al., Gene Therapy 2:710-722 (1995); Ahmad et al., Cancer Res. 52:4817-4820 (1992); U.S. Pat. Nos. 4,186,183, 4,217,344, 4,235,871, 4,261,975, 4,485,054, 4,501,728, 4,774,085, 4,837,028, and 4,946,787).

The use of RNA or DNA viral based systems for the delivery of nucleic acids take advantage of highly evolved processes for targeting a virus to specific cells in the body and trafficking the viral payload to the nucleus. Viral vectors can be administered directly to patients (in vivo) or they can be used to treat cells in vitro, and the modified cells may optionally be administered to patients (ex vivo). Conventional viral based systems could include retroviral, lentivirus, adenoviral, adeno-associated and herpes simplex virus vectors for gene transfer. Integration in the host genome is possible with the retrovirus, lentivirus, and adeno-associated virus gene transfer methods, often resulting in long term expression of the inserted transgene. Additionally, high transduction efficiencies have been observed in many different cell types and target tissues.

The tropism of a viruses can be altered by incorporating foreign envelope proteins, expanding the potential target population of target cells. Lentiviral vectors are retroviral vectors that are able to transduce or infect non-dividing cells and typically produce high viral titers. Selection of a retroviral gene transfer system would therefore depend on the target tissue. Retroviral vectors are comprised of cis-acting long terminal repeats with packaging capacity for up to 6-10 kb of foreign sequence. The minimum cis-acting LTRs are sufficient for replication and packaging of the vectors, which are then used to integrate the therapeutic gene into the target cell to provide permanent transgene expression. Widely used retroviral vectors include those based upon murine leukemia virus (MuLV), gibbon ape leukemia virus (GaLV), Simian Immuno deficiency virus (SIV), human immuno deficiency virus (HIV), and combinations thereof (see, e.g., Buchscher et al., J. Virol. 66:2731-2739 (1992); Johann et al., J. Virol. 66:1635-1640 (1992); Sommnerfelt et al., Virol. 176:58-59 (1990); Wilson et al., J. Virol. 63:2374-2378 (1989); Miller et al., J. Virol. 65:2220-2224 (1991); PCT/US94/05700). In applications where transient expression is preferred, adenoviral based systems may be used. Adenoviral based vectors are capable of very high transduction efficiency in many cell types and do not require cell division. With such vectors, high titer and levels of expression have been obtained. This vector can be produced in large quantities in a relatively simple system. Adeno-associated virus ("AAV") vectors may also be used to transduce cells with target nucleic acids, e.g., in the in vitro production of nucleic acids and peptides, and for in vivo and ex vivo gene therapy procedures (see, e.g., West et al., Virology 160:38-47 (1987); U.S. Pat. No. 4,797,368; WO 93/24641; Kotin, Human Gene Therapy 5:793-801 (1994); Muzyczka, J. Clin. Invest. 94:1351 (1994). Construction of recombinant AAV vectors are described in a number of publications, including U.S. Pat. No. 5,173,414; Tratschin et al., Mol. Cell. Biol. 5:3251-3260 (1985); Tratschin, et al., Mol. Cell. Biol. 4:2072-2081 (1984); Hermonat & Muzyczka, PNAS 81:6466-6470 (1984); and Samulski et al., J. Virol. 63:03822-3828 (1989).

Packaging cells are typically used to form virus particles that are capable of infecting a host cell. Such cells include 293 cells, which package adenovirus, and ψ2 cells or PA317 cells, which package retrovirus. Viral vectors used in gene therapy are usually generated by producing a cell line that packages a nucleic acid vector into a viral particle. The vectors typically contain the minimal viral sequences required for packaging and subsequent integration into a host, other viral sequences being replaced by an expression cassette for the polynucleotide(s) to be expressed. The missing viral functions are typically supplied in trans by the packaging cell line. For example, AAV vectors used in gene therapy typically only possess ITR sequences from the AAV genome which are required for packaging and integration into the host genome. Viral DNA is packaged in a cell line, which contains a helper plasmid encoding the other AAV genes, namely rep and cap, but lacking ITR sequences. The cell line may also be infected with adenovirus as a helper. The helper virus promotes replication of the AAV vector and expression of AAV genes from the helper plasmid. The helper plasmid is not packaged in significant amounts due to a lack of ITR sequences. Contamination with adenovirus can be reduced by, e.g., heat treatment to which adenovirus is more sensitive than AAV. Additional methods for the delivery of nucleic acids to cells are known to those skilled in the art. See, for example, US20030087817, incorporated herein by reference.

Kits, Vectors, Cells

Some aspects of this disclosure provide kits comprising a nucleic acid construct comprising a nucleotide sequence encoding an adenosine deaminase capable of deaminating an adenosine in a deoxyribonucleic acid (DNA) molecule. In some embodiments, the nucleotide sequence encodes any of the adenosine deaminases provided herein. In some embodiments, the nucleotide sequence comprises a heterologous promoter that drives expression of the adenosine deaminase.

Some aspects of this disclosure provide kits comprising a nucleic acid construct, comprising (a) a nucleotide sequence encoding a napDNAbp (e.g., a Cas9 domain) fused to an adenosine deaminase, or a fusion protein comprising a napDNAbp (e.g., Cas9 domain) and an adenosine deaminase as provided herein; and (b) a heterologous promoter that drives expression of the sequence of (a). In some embodiments, the kit further comprises an expression construct encoding a guide nucleic acid backbone, (e.g., a guide RNA backbone), wherein the construct comprises a cloning site positioned to allow the cloning of a nucleic acid sequence identical or complementary to a target sequence into the guide nucleic acid (e.g., guide RNA backbone).

Some aspects of this disclosure provide cells comprising any of the adenosine deaminases, fusion proteins, or complexes provided herein. In some embodiments, the cells comprise a nucleotide that encodes any of the adenosine deaminases or fusion proteins provided herein. In some embodiments, the cells comprise any of the nucleotides or vectors provided herein.

In some embodiments, a host cell is transiently or non-transiently transfected with one or more vectors described herein. In some embodiments, a cell is transfected as it naturally occurs in a subject. In some embodiments, a cell that is transfected is taken from a subject. In some embodiments, the cell is derived from cells taken from a subject, such as a cell line. A wide variety of cell lines for tissue culture are known in the art. Examples of cell lines include, but are not limited to, C8161, CCRF-CEM, MOLT, mIMCD-3, NHDF, HeLa-S3, Huh1, Huh4, Huh7, HUVEC, HASMC, HEKn, HEKa, MiaPaCell, Panc1, PC-3, TF1, CTLL-2, C1R, Rat6, CV1, RPTE, A10, T24, J82, A375, ARH-77, Calu1, SW480, SW620, SKOV3, SK-UT, CaCo2, P388D1, SEM-K2, WEHI-231, HB56, TIB55, Jurkat, J45.01, LRMB, Bcl-1, BC-3, IC21, DLD2, Raw264.7, NRK, NRK-52E, MRC5, MEF, Hep G2, HeLa B, HeLa T4, COS, COS-1, COS-6, COS-M6A, BS—C-1 monkey kidney epithelial, BALB/3T3 mouse embryo fibroblast, 3T3 Swiss, 3T3-L1, 132-d5 human fetal fibroblasts; 10.1 mouse fibroblasts, 293-T, 3T3, 721, 9L, A2780, A2780ADR, A2780cis, A 172, A20, A253, A431, A-549, ALC, B16, B35, BCP-1 cells, BEAS-2B, bEnd.3, BHK-21, BR 293. BxPC3. C3H-10T1/2, C6/36, Cal-27, CHO, CHO-7, CHO-IR, CHO-K1, CHO-K2, CHO-T, CHO Dhfr-/-, COR-L23, COR-L23/CPR, COR-L23/5010, COR-L23/R23, COS-7, COV-434, CML T1, CMT, CT26, D17, DH82, DU145, DuCaP, EL4, EM2, EM3, EMT6/AR1, EMT6/AR10.0, FM3, H1299, H69, HB54, HB55, HCA2, HEK-293, HeLa, Hepa1c1c7, HL-60, HMEC, HT-29, Jurkat, JY cells, K562 cells, Ku812, KCL22, KG1, KYO1, LNCap, Ma-Mel 1-48, MC-38, MCF-7, MCF-10A, MDA-MB-231, MDA-MB-468, MDA-MB-435, MDCK II, MDCK 11, MOR/0.2R, MONO-MAC 6, MTD-1A, MyEnd, NCI-H69/CPR, NCI-H69/LX10, NCI-H69/LX20, NCI-H69/LX4, NIH-3T3, NALM-1, NW-145, OPCN/OPCT cell lines, Peer, PNT-1A/PNT 2, RenCa, RIN-5F, RMA/RMAS, Saos-2 cells, Sf-9, SkBr3, T2, T-47D, T84, THP1 cell line, U373, U87, U937, VCaP, Vero cells, WM39, WT-49, X63, YAC-1, YAR, and transgenic varieties thereof. Cell lines are available from a variety of sources known to those with skill in the art (see, e.g., the American Type Culture Collection (ATCC) (Manassas, Va.)). In some embodiments, a cell transfected with one or more vectors described herein is used to establish a new cell line comprising one or more vector-derived sequences. In some embodiments, a cell transiently transfected with the components of a CRISPR system as described herein (such as by transient transfection of one or more vectors, or transfection with RNA), and modified through the activity of a CRISPR complex, is used to establish a new cell line comprising cells containing the modification but lacking any other exogenous sequence. In some embodiments, cells transiently or non-transiently transfected with one or more vectors described herein, or cell lines derived from such cells are used in assessing one or more test compounds.

The description of exemplary embodiments of the reporter systems above is provided for illustration purposes only and not meant to be limiting. Additional reporter systems, e.g., variations of the exemplary systems described in detail above, are also embraced by this disclosure.

It should be appreciated however, that additional fusion proteins would be apparent to the skilled artisan based on the present disclosure and knowledge in the art.

The function and advantage of these and other embodiments of the present invention will be more fully understood from the Examples below. The following Examples are intended to illustrate the benefits of the present invention and to describe particular embodiments, but are not intended to exemplify the full scope of the invention. Accordingly, it will be understood that the Examples are not meant to limit the scope of the invention.

EXAMPLES

In order that the invention described herein may be more fully understood, the following examples are set forth. It should be understood that these examples are for illustrative purposes only and are not to be construed as limiting this invention in any manner.

Example 1

Base editors, catalytically impaired Cas9 proteins fused to nucleobase modification enzymes, enable targeted single-nucleotide conversion in the genomes of a wide range of cells and organisms without inducing double-stranded DNA breaks. Previously, both C·G-to-T·A base editors (BE3 and BE4) and A·T-to-G·C base editors (ABE) were developed, and their targeting scope, product purity, and DNA specificity were enhanced. The usefulness of base editors for research and therapeutic applications is also strongly dependent on the efficiency with which they can modify target nucleotides. Here, factors that limit base editing efficiency in mammalian cells were examined and it was determined that the expression level and nuclear localization of current-generation BE4 and ABE base editors limit their editing efficiency. By improving the nuclear localization signal (NLS), optimizing the codon usage of base editor constructs, and performing ancestral reconstruction of the component deaminase domains, the efficiency of BE4- and ABE-mediated genome editing was greatly improved, in most tested cases to ~80% target base conversion in HEK293T cells. It is shown that these optimized "BE4 max", "AncBE4 max", and "ABEmax" base editors are especially enabling under unfavorable conditions such as when delivery of constructs is limiting. These optimized editors corrected several pathogenic SNPs in a variety of mammalian cell types with substantially higher efficiencies than BE4 and ABE. AncBE4 max, BE4 max, and ABEmax substantially expand the capabilities of both cytidine and adenosine base editing and represent current state-of-the-art mammalian cell base editors.

Point mutations represent the majority of known human genetic variants associated with disease[1]. Developing robust methods to introduce and correct point mutations is therefore an important challenge to understand and treat diseases with a genetic component. Base editors, fusions of catalytically disabled Cas9, natural or evolved nucleobase deaminases, and, in some cases, proteins have been recently developed, that alter cellular DNA repair processes to increase the efficiency and stability of the resulting single-nucleotide change[2, 3]. Two classes of base editors have been described to date: cytidine base editors convert target C·G base pairs to T·A, and adenosine base editors convert A·T to G·C. Collectively, these two classes of base editors enable the targeted installation of all four transition mutations (C-to-T, G-to-A, A-to-G, and T-to-C), which collectively account for 61% of known human pathogenic SNPs in the ClinVar database (FIGS. 1A, 1B). Base editors have been used widely in organisms ranging from prokaryotes to plants to amphibians to mammals, and have even been used to correct pathogenic mutations in human embryos[4-18].

The utility of base editing is limited by several constraints, including the PAM requirement imposed by the Cas9 moiety, off-target base editing, "bystander editing" of non-target Cs or As very close to the target nucleotides, the production of undesired byproducts, and overall editing efficiency. Next-generation base editors have been developed that address some of these limitations, including base editors with different or expanded PAM compatibilities[19-21], high-fidelity base editors with reduced off-target activity[20, 22-25], base editors with narrowed editing windows (normally ~5 nucleotides wide)[19], and a current-generation cytidine base editor (BE4) with greatly reduced byproducts[6].

Despite these recent advances, the efficiency of base editing by BE4 and current adenine base editor (ABE) variants varies widely by cell type and target locus. To broadly increase base editing efficiency, it was sought to identify the factors that limit base editing efficiency in mammalian cells. In this study it was found that for both BE4 and ABE, expression and nuclear localization in human cells impose key bottlenecks on editing efficiency. Optimizing codon usage, using improved nuclear localization sequences (NLSs), and performing ancestral reconstruction of cytidine deaminases result in base editors with greatly increased editing efficiency, often more than doubling target nucleotide conversion yields. The resulting AncBE4 max, BE4 max, and ABEmax base editors install point mutations relevant to human disease in a variety of mammalian cell types much more efficiently than previously described base editors. AncBE4 max, BE4 max, and ABEmax substantially advance the utility of both classes of base editors, and their use is recommended for general base editing applications in mammalian cells.

Results

Several factors could limit the ability of a base editor to achieve conversion of the target nucleotide. If the base editor is delivered as encoded DNA or RNA, cellular uptake of the nucleic acid can be limiting. Among cells that have acquired a DNA construct encoding a base editor, transcription may be limited by the choice of promoter or regulatory sequences or by the editor's coding sequence. Once transcribed, translation efficiency may also be limiting depending on factors including codon usage and mRNA processing. In protein form, a base editor protein may be inefficiently trafficked to the nucleus or may be degraded too quickly. Given that APOBEC1, the cytidine deaminase component of BE4, expresses poorly in bacteria[26] it was speculated that altering the coding sequence or codon usage of this component might augment base editing efficiency.

These possibilities were dissected using three fluorescent protein expression experiments. To establish a baseline editing efficiency level among viable cells capable of taking up plasmid DNA during transfection, a three-plasmid mixture consisting of a plasmid expressing BE4, a plasmid expressing an sgRNA, and a separate plasmid expressing mCherry, were co-transfected into human HEK293T cells to mark viable cells that received plasmid. Base editing was measured by high-throughput DNA sequencing (HTS) from mCherry-positive cells isolated by FACS, revealing an average of 45±7.1% C·G-to-T·A editing across the base editing activity window (positions 4-8, counting the PAM as positions 21-23) at five test genomic loci (FIG. 1C, 1D). To examine editing efficiency only among cells that contain the DNA plasmid encoding the base editor, HEK293T cells were transfected with a two-plasmid mixture consisting of a plasmid encoding an sgRNA and a separate plasmid encoding both BE4 and GFP, expressed from separate promoters. Isolation by FACS of GFP-positive cells followed by HTS resulted in an average of 35±7.3% editing at the same five test sites (FIG. 1D). The lack of improvement in editing efficiencies among GFP-positive cells containing the base editor plasmid in the second experiment versus transfected (mCherry-positive) cells in the first experiment suggests that transfection of HEK293T cells was not limiting base editing outcomes.

In a third experiment, editing efficiencies in HEK293T cells were evaluated following transfection of a BE4-P2A-GFP construct, where P2A is a self-cleaving peptide[27] that enables co-expression of the GFP protein from the same mRNA transcript as BE4. GFP-positive cells in this experiment can arise only if they also produce full-length BE4 protein. Among GFP-positive cells, base editing efficiencies averaged 65±6.4%, 1.9-fold higher than the average editing efficiencies following transfection of the single plasmid expressing BE4 and GFP from separate promoters (FIG. 1E). These results strongly suggest that the fraction of cells expressing active base editors, and/or the amount of functional base editor protein produced by each cell, are major bottlenecks of base editing efficiency.

Figure 2A:
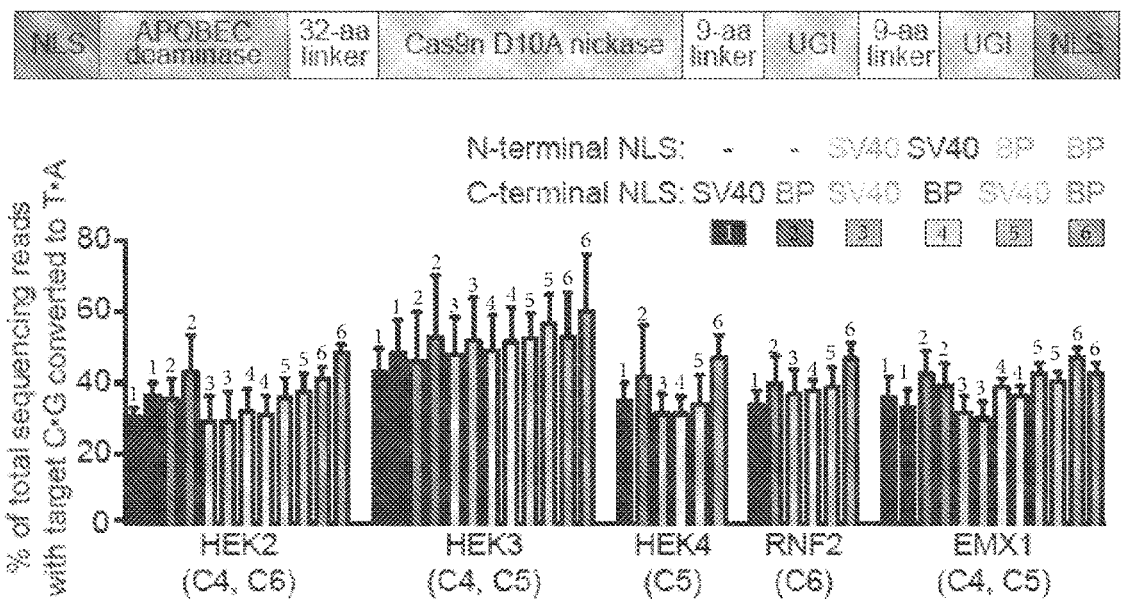
FIGS. 2A-2E. Optimization of the BE4 C·G-to-T·A base editor by improving nuclear localization, improving codon usage, and performing ancestral protein reconstruction of cytidine deaminases.

To probe the possibility of sub-optimal nuclear localization, all six combinations of BE4 N- and C-terminal fusion were tested either to the SV40 NLS used in BE4, or to a bipartite NLS (bpNLS) previously shown to improve nuclear localization of Cas9[28] (FIG. 2A). All variants using one or two bpNLSs showed improvements in editing efficiency. The presence of a bpNLS at both the N- and C-terminus (referred to hereafter as "bis-bpNLS") performed best, resulting in a 1.3-fold average improvement in BE4-mediated C·G-to-T·A editing efficiency at five tested genomic loci (48±8.0% average editing compared to 37±5.6% for the C-terminal SV40 NLS used in BE4) (FIG. 2A; see FIG. 5A for p-values). These results together suggest that the use of a bis-bpNLS can significantly improve the editing efficiency of previously described BE3 and BE4[6, 7].

Next, it was speculated that improving codon usage might enhance base editor expression. To test this possibility, the improved bis-bpNLS form of BE4 (bpNLS-BE4-bpNLS)

coded with eight distinct full-length and chimeric codon optimization strategies was compared. Previously reported BE4 and ABE used codon optimization from IDT (Integrated DNA Technologies)[3, 6]. First C·G-to-T·A editing efficiencies of bis-bpNLS BE4 constructs that use codon optimization from IDT, GeneArt, Coller and co-workers[29], and GenScript were compared. At the five endogenous loci in HEK293T cells, all tested new codon optimizations resulted in improved editing efficiency compared to that of the original IDT codons. The best-performing variant used GenScript codons and resulted in an additional 1.8-fold higher editing over bis-bpNLS BE4 with IDT codons, enabling average editing in HEK293T cells of 62±7.8% (FIG. 2B; see FIG. 5B for p-values).

Figure 6A:
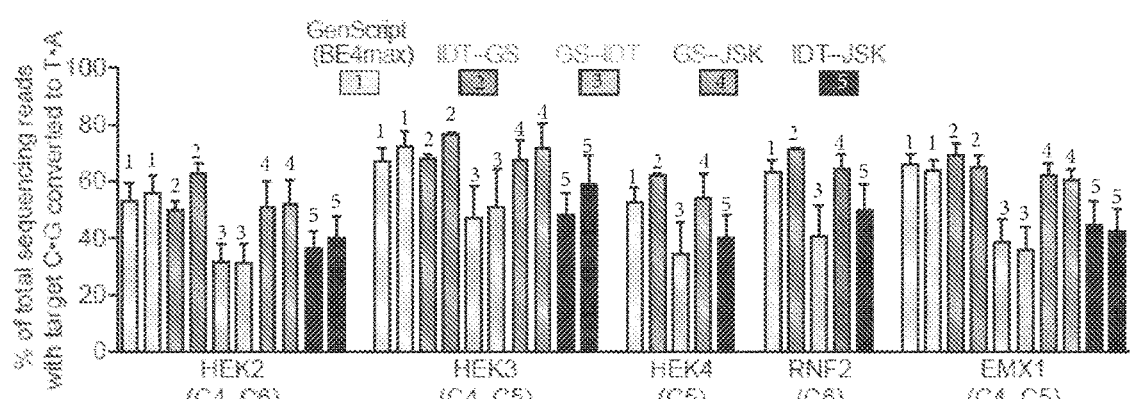
FIGS. 6A-6B. C·G-to-T·A base editing outcomes for BE4 variants with chimeric codon usages.
Figure 6B:
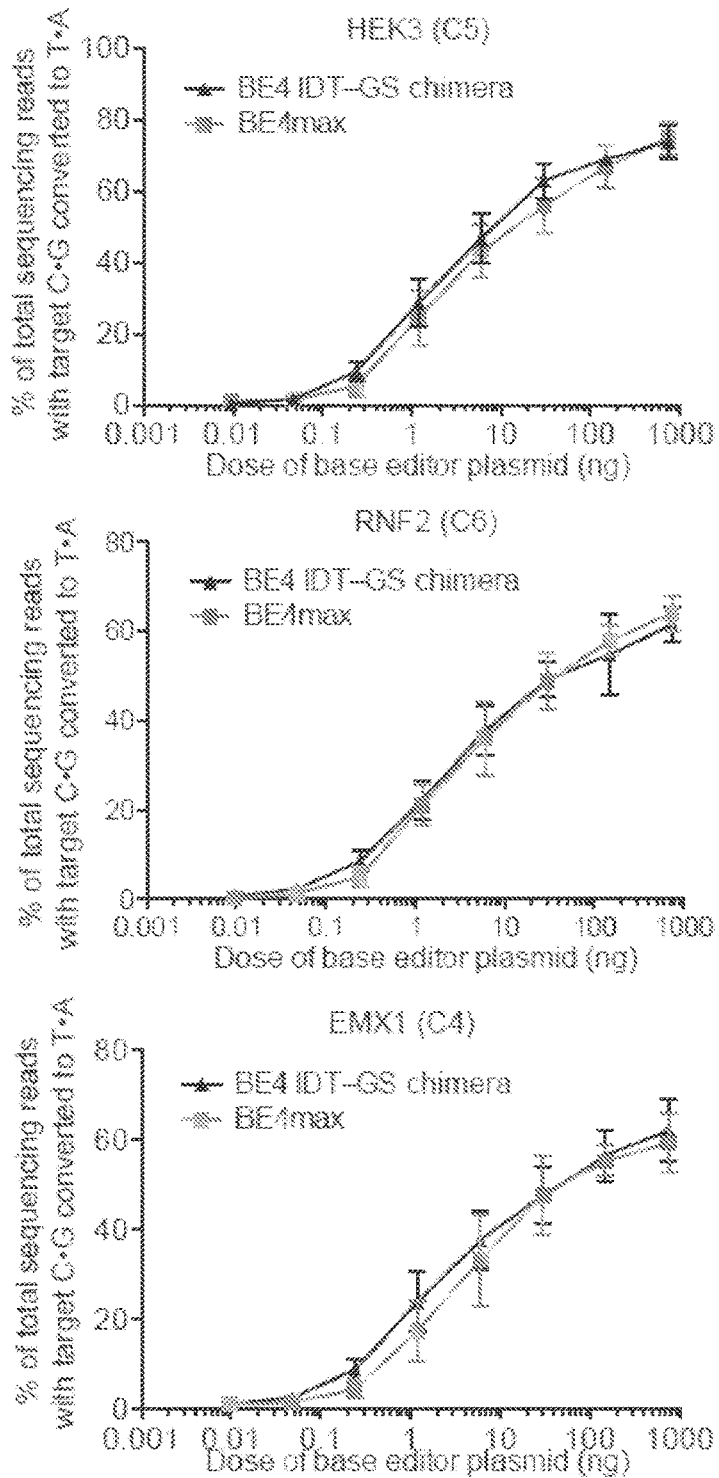

To more deeply dissect the effects of codon optimization, chimeric codon-optimized BE4 variants containing Cas9 nickase coding sequences previously reported by Kim and coworkers to improve expression in human cells,[30] were also tested together with cytidine deaminase and UGI domains with codons from IDT or GenScript. The results reveal that both Cas9 nickase and APOBEC codon usage influence BE4 editing efficiency (FIG. 6A). None of the chimeric codon-optimized constructs tested (APOBEC/Cas9 codon usage=IDT/GenScript, GenScript/IDT, GenScript/Kim, or IDT/Kim) resulted in significantly increased BE4 editing efficiencies compared to the optimized bis-bpNLS BE4 editor using full-length GenScript codon optimization, referred to hereafter as BE4 max (FIGS. 6A-6B). While the chimera of an IDT deaminase with a GenScript Cas9 nickase showed slightly improved average editing outcomes relative to BE4 max at a single high dose of plasmid (FIG. 2B), when tested across an eight-dose plasmid titration at three genomic loci this chimera did not show improved editing compared to BE4 max (FIG. 6B). Collectively, these findings establish that codon optimization can dramatically improve the activity of BE4-mediated base editing in human cells.

Figure 2B:
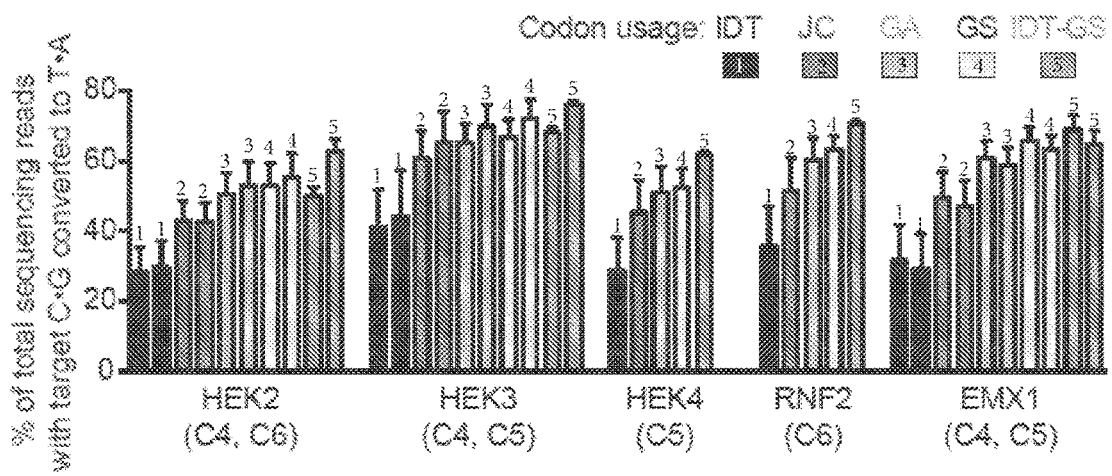

The above results implicate both APOBEC1 cytidine deaminase and Cas9 nickase expression as key determinants of base editing efficiency (FIG. 2B and FIG. 6A). To further explore strategies for enhancing APOBEC1 expression, ancestral sequence reconstruction (ASR) was performed by maximum likelihood using a set of 468 APOBEC homologs. ASR uses an alignment of known protein sequences, an evolutionary model, and a resulting phylogenetic tree to infer ancestral protein sequences at the nodes of the phylogeny[31]. ASR has been previously shown to greatly improve the expression of a variety of proteins while retaining wild-type levels of biochemical activity[32-35]. In particular, maximum likelihood reconstructions have been reported to generate sequences with higher expression levels compared to Bayesian reconstructions[36, 37]. While the reasons for improved expression of ancestral proteins remain actively debated[32, 36-38], surprisingly few cases have exploited this phenomenon for protein engineering[39-41].

Figure 2C:
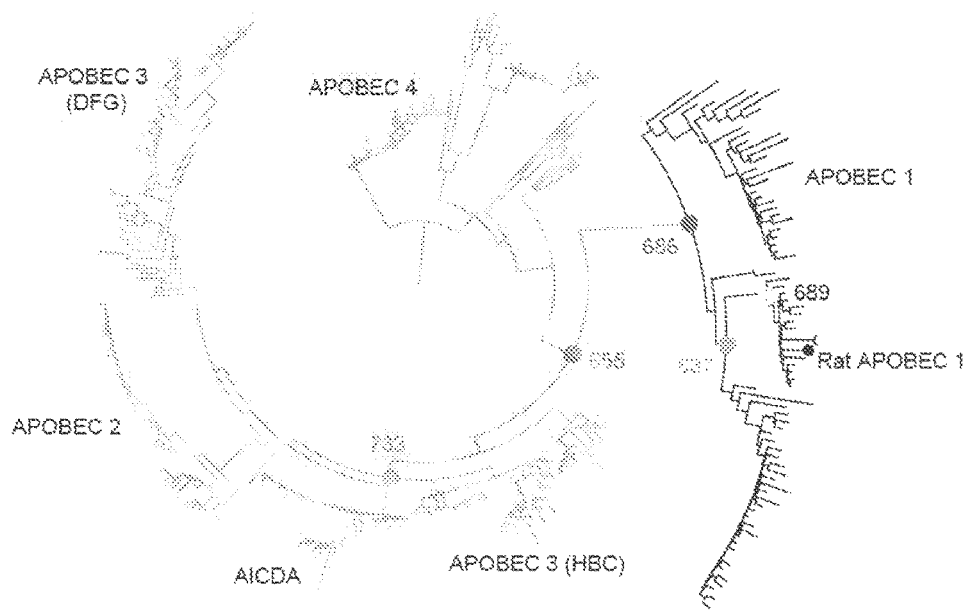
Figure 2D:
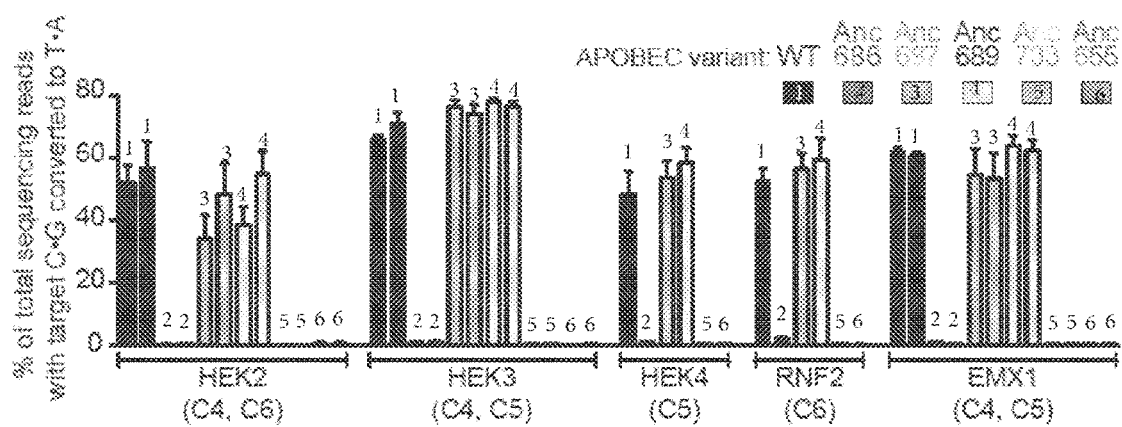
Figure 7:
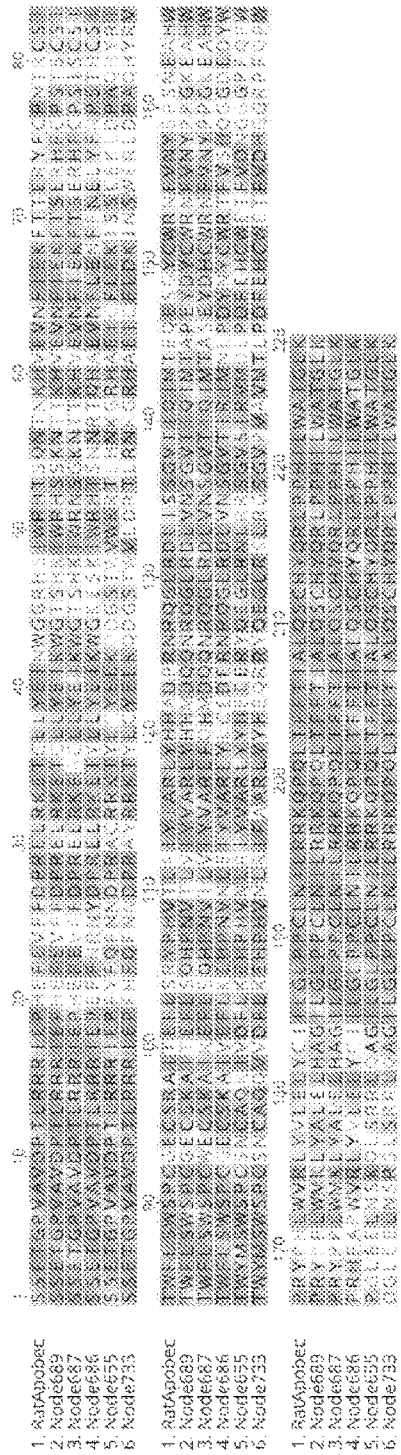
FIG. 7. Multiple sequence alignment of rat APOBEC1 and reconstructed ancestral cytidine deaminases. Residues are shaded based on the degree of conservation. The sequences from top to bottom correspond to SEQ ID NOs: 4-9.

Using the set of 468 APOBEC homologs ("Sequences 5", below) a maximum likelihood phylogeny was created and the most likely sequences at internal nodes were inferred (FIG. 2C). Five ancestral cytidine deaminases selected at increasing evolutionary distance from rat APOBEC1 used in BE4 were characterized as base editors (FIG. 7). Two ancestors (Anc689 and Anc687) closest in evolutionary distance to the rat APOBEC1 used in BE4 (36 and 45 amino acid differences vs. BE4, respectively) resulted in high editing efficiencies across the five genomic test loci in HEK293T cells, similar to those of BE4 max (Anc689: 62±4.9%; Anc687: 57±6.7%; BE4 max: 59±4.9%) (FIG. 2D).

Figure 2E:
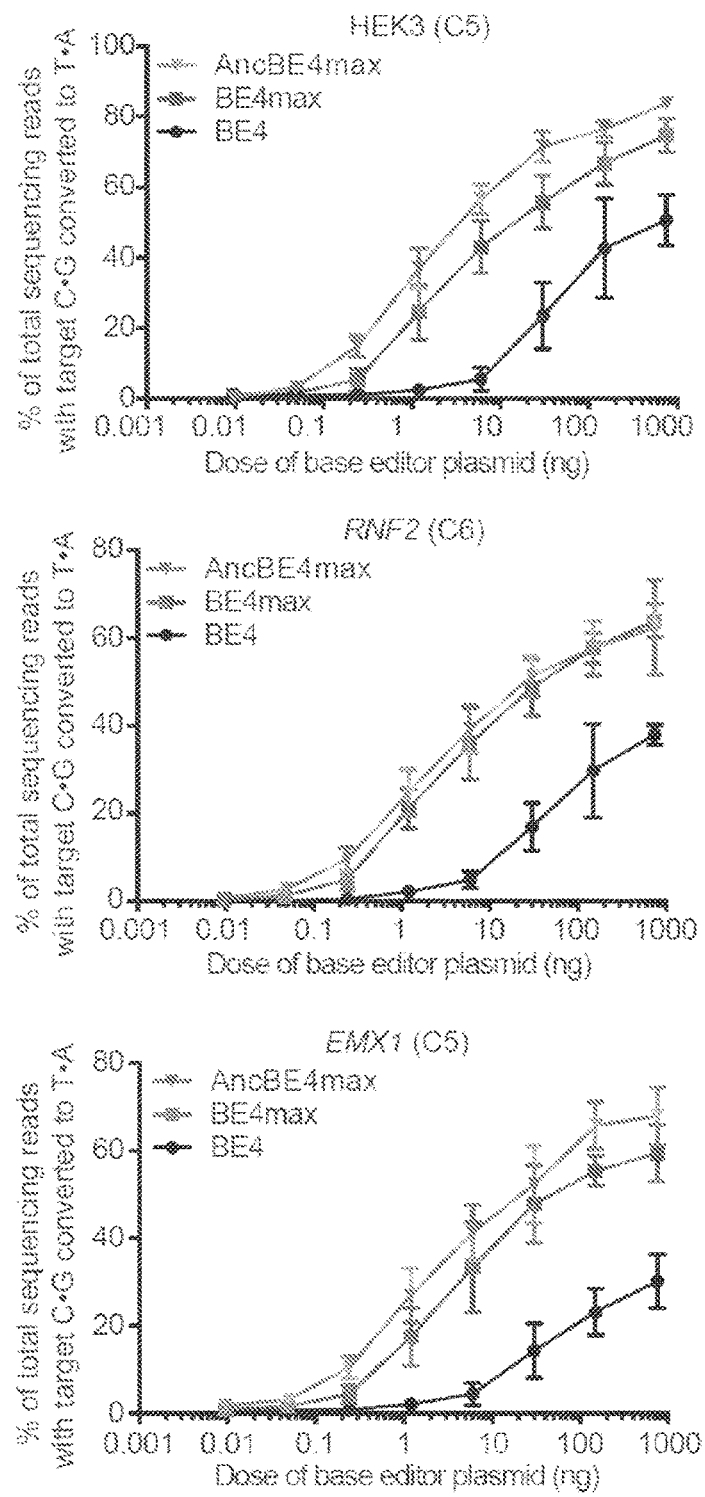

To characterize in depth the base editing activities that result from these improvements, including under sub-optimal conditions, across eight different doses of base editor plasmid at three genomic loci, the editing efficiencies of the previously reported BE4[6] were compared with those of the three most promising BE4 variants generated in this work: BE4 max, bis-npNLS BE4 using the chimeric IDT/GenScript codon optimization, and bis-npNLS BE4 with the Anc689 ancestral APOBEC domain and GenScript codons (referred to hereafter as AncBE4 max) (FIG. 2E, p-values reported in FIGS. 8A-8C). The improvements offered by all three of these optimized editors over BE4 are dramatic, ranging from 1.7-fold at higher plasmid doses to >9-fold at lower plasmid doses (FIG. 2E). Ratios of desired point mutation to indels were also improved among all three of these optimized editors compared with the original BE4, as indel frequencies remained similar or lower while base editing improved substantially (FIG. 9). AncBE4 max consistently offered the highest activity at target Cs across all three tested sites over a wide range of plasmid doses spanning four orders of magnitude (FIG. 2E; see FIG. 8C for p-values). BE4 max resulted in editing efficiencies slightly below, or similar to, those of AncBE4 max (FIG. 2E). These data suggest that AncBE4 max and BE4 max offer large improvements in editing efficiency over BE4, especially under sub-optimal conditions in which factors such as delivery limit overall editing efficiency. As many genome editing applications operate under sub-optimal conditions constrained by poor delivery, or by limited editing opportunities in time or space, it was anticipated that AncBE4 max and BE4 max will be useful in many settings.

Figure 10A:
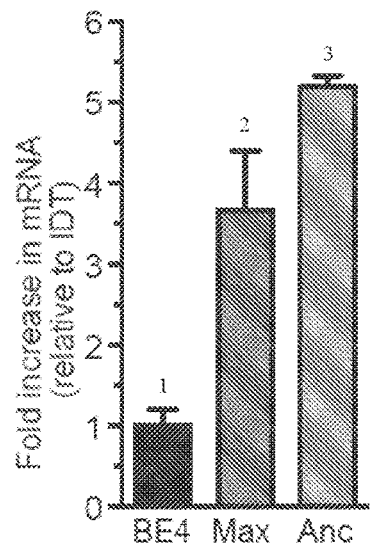
FIGS. 10A-10D. Improved mRNA levels, protein levels, and base editing from BE4 max and AncBE4 max compared with BE4.
Figure 10B:
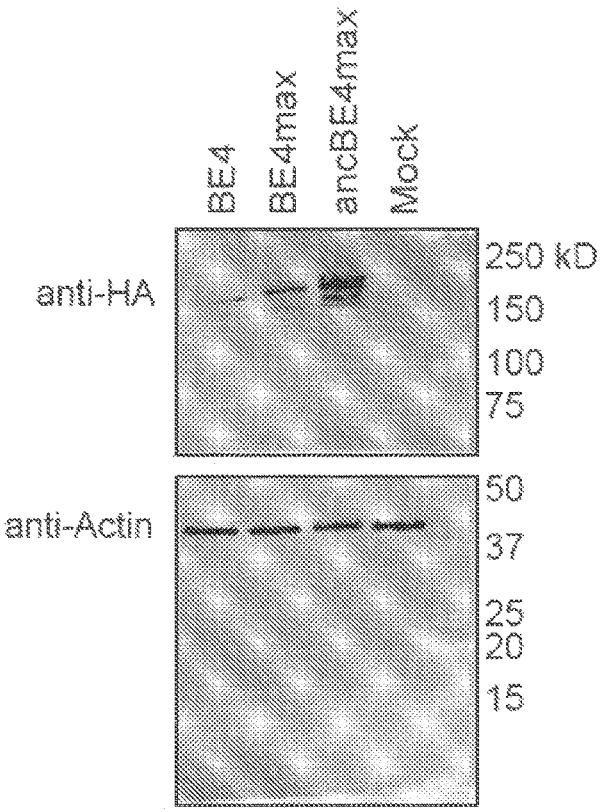

Next, it was determined if the AncBE4 max and BE4 max result in increased mRNA and protein levels in human cells relative to the previously reported BE4. HEK293T cells were separately transfected with 250 ng of guide RNA and 750 ng of plasmid encoding BE4-P2A-GFP, BE4 max-P2A-GFP, or AncBE4 max-P2A-GFP. After 3 days, cells were subjected to reverse transcription using GFP-specific primers to evaluate the amount of base editor mRNA present in each sample. BE4 max showed >3-fold higher mRNA expression compared to that of BE4, while AncBE4 max showed >5-fold higher mRNA expression when compared to BE4 (FIG. 10A). To compare protein levels of BE4 versus BE4 max and AncBE4 max, HEK293T cells were transfected as described above with plasmids encoding C-terminally epitope-tagged BE4, BE4 max, and AncBE4 max and performed western blots on the resulting cell lysates. The data reveal that both BE4 max and, especially, AncBE4 max result in substantial increases in full-length protein abundance relative to actin controls (FIG. 10B). Together, these results indicate that the optimizations that led to BE4 max and AncBE4 max resulted in major increases in mRNA and protein levels of full-length base editors.

Figure 10C:
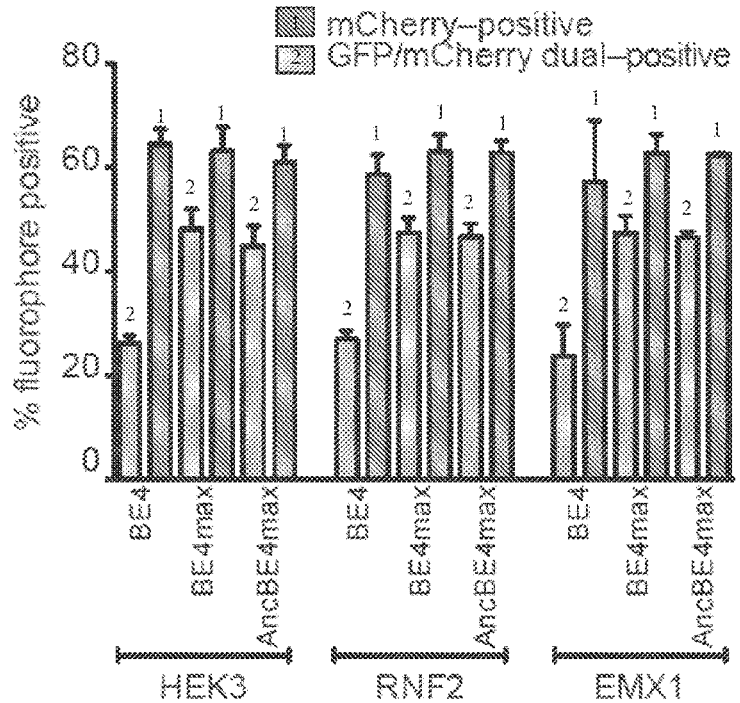
Figure 10D:
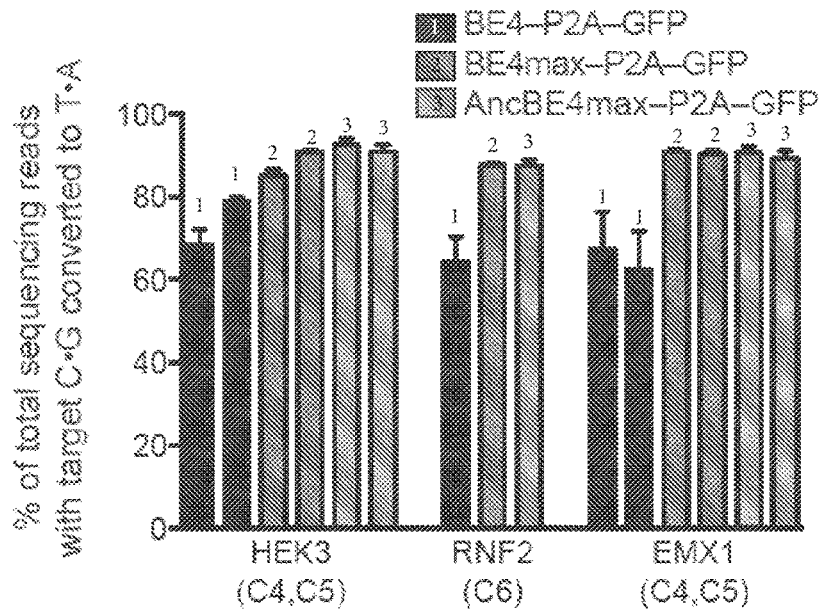

The relationship between improved base editor expression and improved editing efficiency was further illuminated by flow cytometry. HEK293T cells expressing BE4 max-P2A-GFP and AncBE4 max-P2A-GFP targeted to three test genomic loci were sorted. While the fraction of viable and transfectable (mCherry-positive) cells was very similar among BE4 max-P2A-GFP (63±3.8%), AncBE4 max-P2A-GFP (62±2.3%), and BE4-P2A-GFP (60±7.0%) across the three genomic sites tested, the frequency of GFP and mCherry double-positive cells, reflecting full-length base editor expression, was on average 1.7-fold higher for both BE4 max-P2A-GFP and AncBE4 max-P2A-GFP compared to BE4 (FIG. 10C). These improvements in editor expression were reflected in improvements in editing activity. Among mCherry and GFP double-positive cells, BE4 max-P2A-GFP showed an average of 89±0.9% target C·G-to-T·A editing across the editing window and AncBE4 max-P2A-GFP led to an average of 90±1.5% editing, while double-positive cells expressing BE4-P2A-GFP averaged 48±8.0% (FIG. 1E, FIG. 9). These large improvements demonstrate that isolating cell populations expressing BE4 max and AncBE4 max results in dramatically higher frequencies of edited cells, which may be especially useful for base editing applications that seek to create novel cell lines, agriculture strains, or animal models.

Figure 3A:
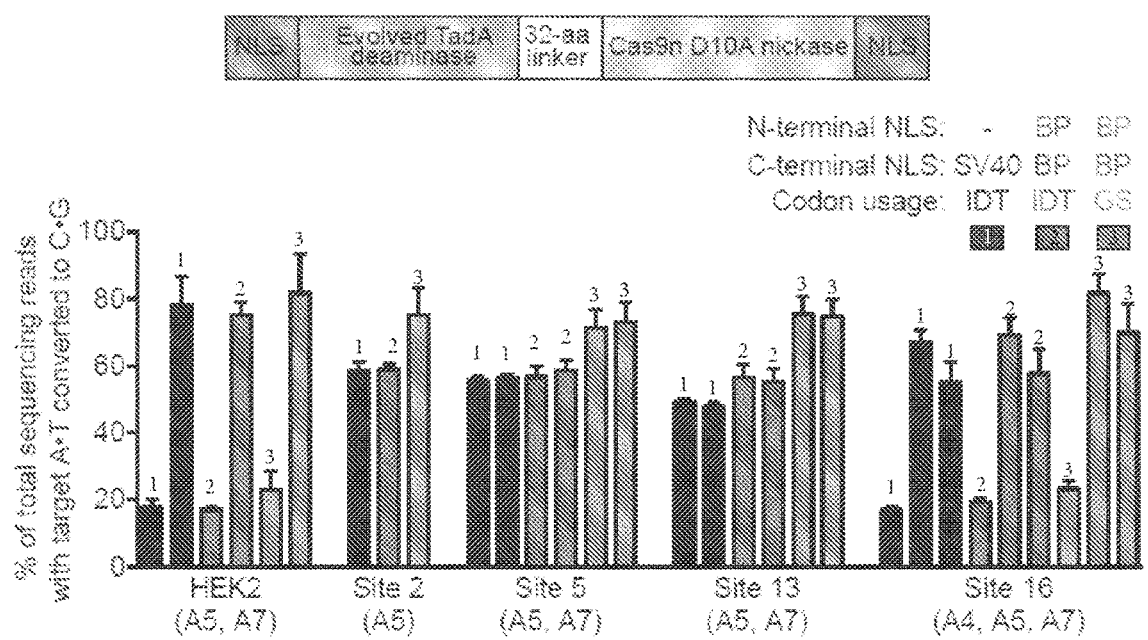
FIGS. 3A-3B. Optimization of the ABE 7.10 A·T-to-G·C base editor by improving nuclear localization and improving codon usage.
Figure 3B:
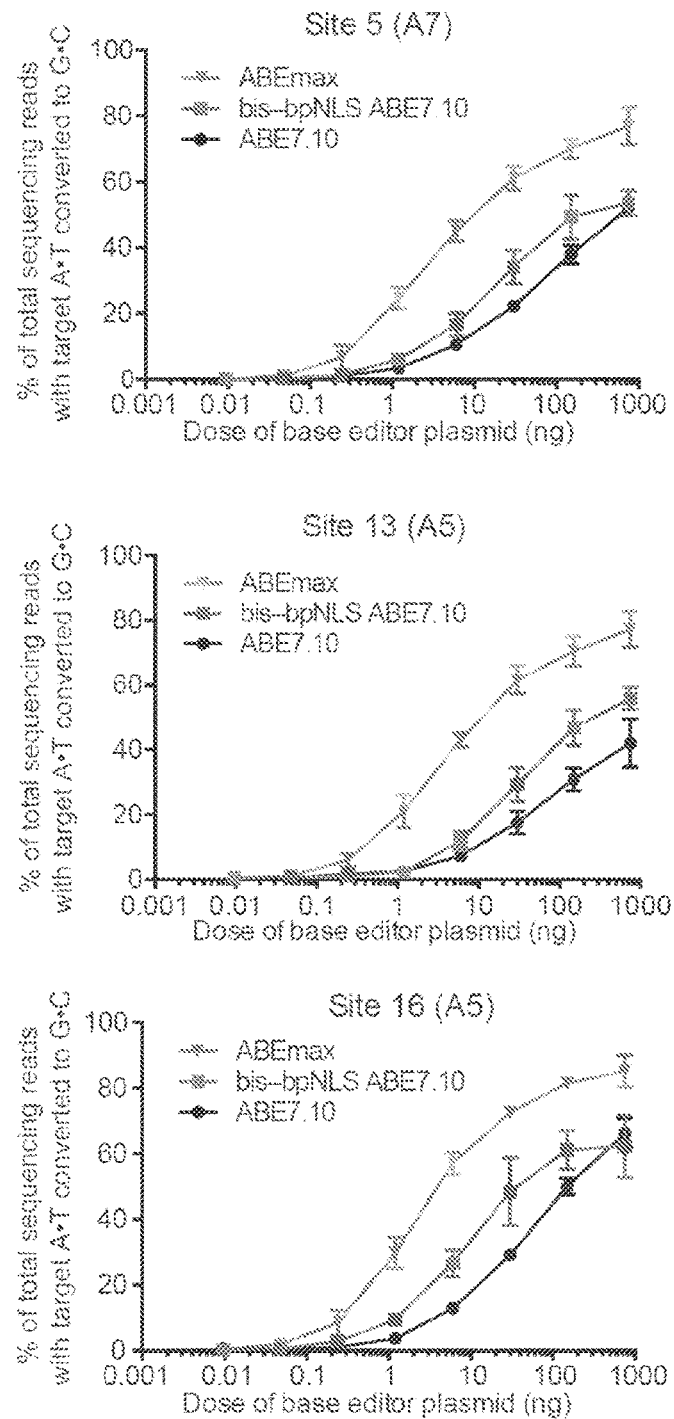

Adenine base editors (ABEs) use a laboratory-evolved deoxyadenosine deaminase and a Cas9 nickase to mediate the conversion of target A·T to G·C base pairs[3]. Because this conversion reverses the most common class of point mutations in living systems (C·G to T·A)[42], ABE have the potential to correct a far larger fraction (47%) of pathogenic SNPs than cytidine base editors (14%) (FIG. 1B). Encouraged by the above improvements in BE4 editing efficiency, next, these principles were applied to improve ABE. The applications began with ABE 7.10, the best-performing ABE variant for general use described to date[3]. While the use of the bis-bpNLS in ABE instead of the previously reported SV40 NLS resulted in little apparent improvement in average A·T-to-G·C editing efficiency in single-dose experiments in HEK293T cells across five human genomic loci test sites (53±3.8% versus 50±3.8% respectively) (FIG. 3A), dose-titration experiments revealed that the bis-bpNLS offered substantially higher ABE editing efficiencies (typically ~1.5- to 2-fold) at sub-optimal ABE doses (FIG. 3B). These observations indicate that replacement of the SV40 NLS with bis-bpNLS also can enhance ABE-mediated editing efficiency.

To test the effect of codon optimization on A·T-to-G·C editing efficiency, the original (IDT codons) form of bis-bpNLS-ABE was compared with the Genscript codon optimization form of the same protein at the five test sites in HEK293T cells. Consistent with the findings for BE4, Genscript codon optimization of bis-bpNLS ABE 7.10 (referred to hereafter as ABEmax) also resulted in substantial benefits to editing efficiency compared with IDT codon optimization. At high single-doses of base editor construct, ABEmax resulted in 1.3-fold higher editing levels than ABE (from 50±3.8% to 65±6.8%) across all five sites tested (FIG. 3A; see FIG. 11A for p-values). At sub-optimal doses, ABEmax improved editing efficiencies up to 7.9-fold over those of ABE 7.10 (from 3.2±1.0% to 25±4.4% average editing across three sites tested at low doses) (FIG. 3B; see FIG. 11B for p-values). Although indels from ABEmax remained rare occurrences (≤1.6%), they were elevated from the virtually undetectable indel levels of ABE 7.103 (FIG. 12). Together, these findings establish that improvements in nuclear localization and expression that benefit cytidine base editors are also applicable to ABEs.

Figure 4A:
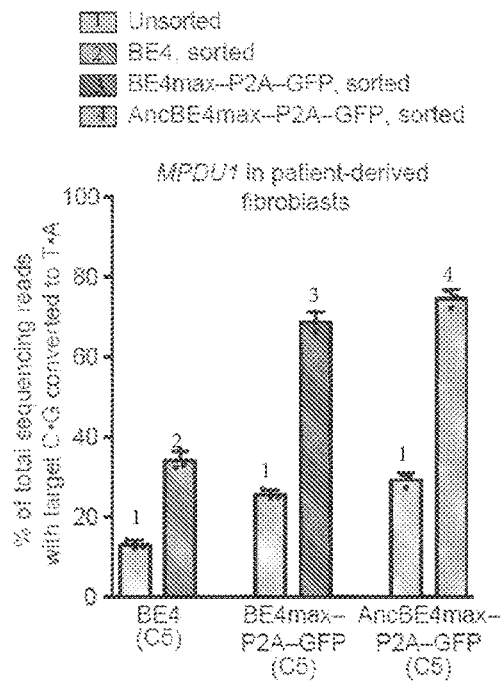
FIGS. 4A-4D. Comparison of optimized AncBE4 max, BE4 max, and ABEmax base editors with previously reported BE4 and ABE 7.10 for the correction of pathogenic SNPs.
Figure 14A:
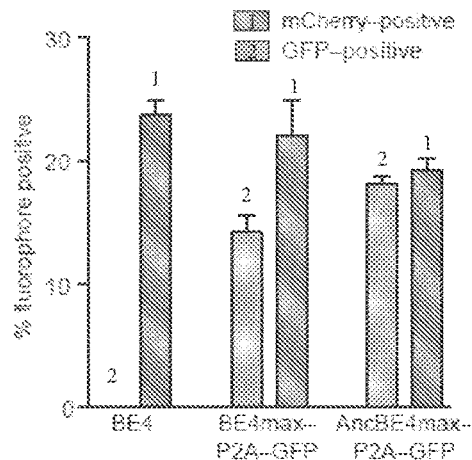
FIGS. 14A-14C. Nucleofection and transfection efficiencies in type 1f fibroblasts, N2a cells, and HEK293T cells for disease-associated targets.

With optimized BE4 max, AncBE4 max, and ABEmax in hand, it was sought to compare them to previously reported BE4 and ABE7.10 for their ability to edit disease-relevant target loci in a variety of cell types. Patient-derived fibroblasts are commonly used for studying genetic diseases. Mutations in MDPU1, a gene central to N-glycan biosynthesis in the endoplasmic reticulum, gives rise to a condition known as congenital disorder of glycosylation type 1f43. Patient-derived fibroblasts harboring the Leu119Pro T>C mutation that drives this disease were nucleofected with plasmids expressing BE4, BE4 max-P2A-GFP, or AncBE4 max-P2A-GFP and the targeting sgRNA. A portion of BE4-treated cells sorted by FACS for an mCherry co-transfection marker, while a portion of cells treated with BE4 max-P2A-GFP and AncBE4 max-P2A-GFP were sorted for GFP-positive cells. Unsorted cells for BE4 showed 13±1.2% correction of the disease-driving SNP in patient-derived fibroblast, while FACS-sorted BE4 samples showed 34±2.4% correction (FIG. 4A). Unsorted BE4 max and AncBE4 max resulted in 26±1.3% and 29±1.7% correction of the Leu119Pro mutation, respectively, while sorted cells treated with BE4 max and AncBE4 max showed 69±2.5% and 75±2.2% SNP correction, respectively (FIG. 4A). Nucleofection efficiencies for all tested conditions were measured by flow cytometry and were consistent across samples, indicating that outcomes were primarily dependent on base editor expression and activity (FIG. 14A). Thus BE4 max and AncBE4 max resulted in 2.0- and 2.2-fold higher editing efficiencies, respectively, of a pathogenic human SNP in patient-derived fibroblasts.

Figure 4B:
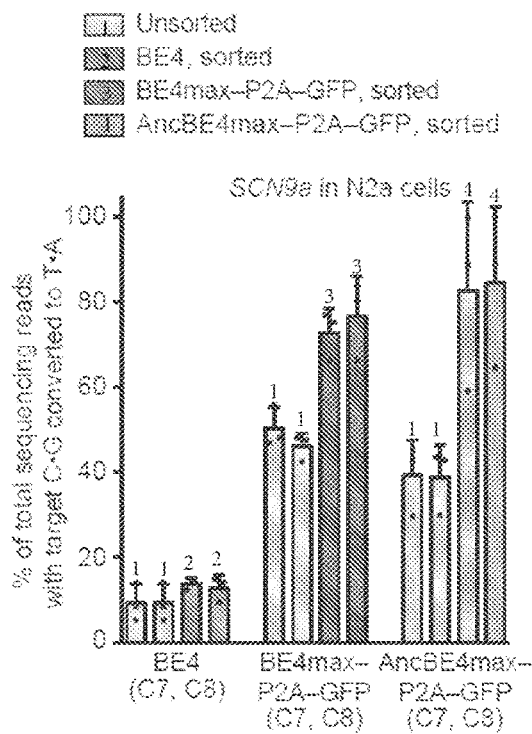
Figure 13:
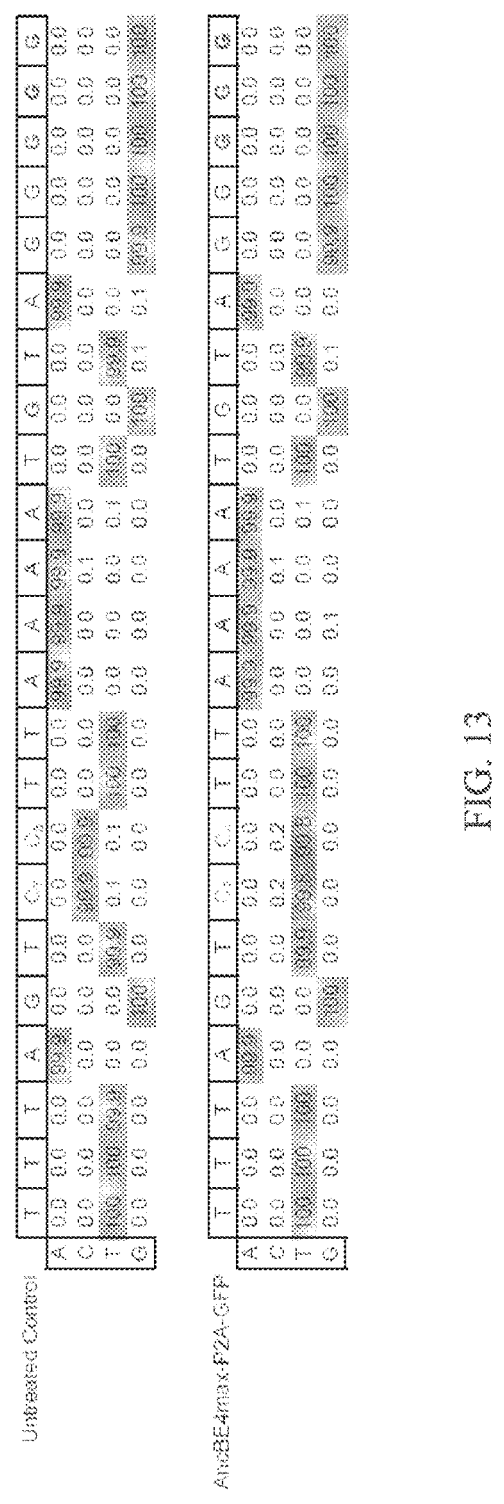
Figure 14B:
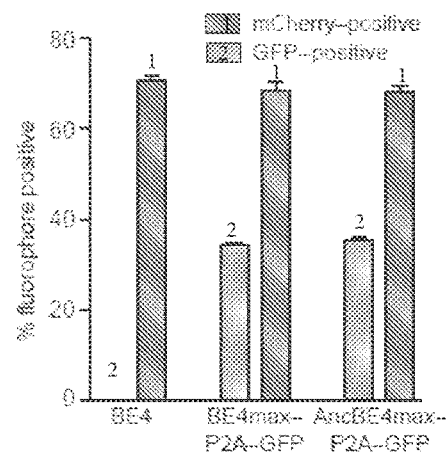

To further test the improvements offered by BE4 max and AncBE4 max, a splice-modifying mutation was installed in mouse N2a neuroblastoma cells in the voltage-gated sodium channel NaV1.7 (SCN9a gene), a target associated with familial erythromyalgia, paroxysmal extreme pain disorder, and chronic insensitivity to pain[44-45]. +1G and −1 G was targeted in the splice acceptor of SCN9a intron 6 by nucleofection of plasmids encoding BE4, BE4 max, or AncBE4 max and the targeting sgRNA. BE4 treatment resulted in 9.3±4.4% editing of both +1 G and −1 G among unsorted cells, and 14±1.3% and 13±3.0% editing among sorted cells, respectively (FIG. 4B). BE4 max resulted in 50±5.0% and 46±3.1% editing of the target +1 G and −1 G in unsorted cells, and 73±5.7% and 77±9.3% editing among sorted cells. Finally, AncBE4 max resulted in 44%±1.7% and 43±0.47% editing of the target +1 G and −1 G in unsorted cells, and 94±7.7% for both target Gs among sorted cells (FIG. 4B). Together, these results demonstrate that BE4 max and AncBE4 max offer large improvements—here, 5- to 7-fold increases—in editing efficiency of a disease-relevant target in mammalian cells. Indeed, AncBE4 max in one sorted sample resulted in 99.8% editing of both target G·C base pairs in SCN9a, demonstrating the very high likelihood of target base editing among cells containing AncBE4 max protein (FIG. 13). Transfection efficiencies for all tested conditions were measured by flow cytometry and were consistent across samples, indicating that outcomes were primarily dependent primarily on base editor expression and activity (FIG. 14B).

Figure 4C:
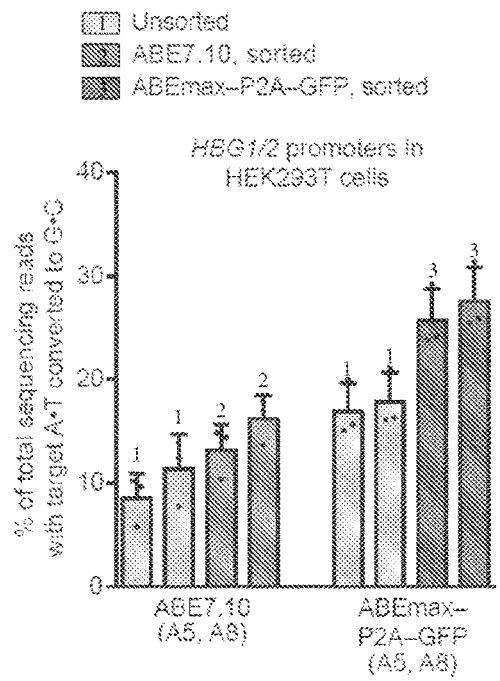
Figure 4D:
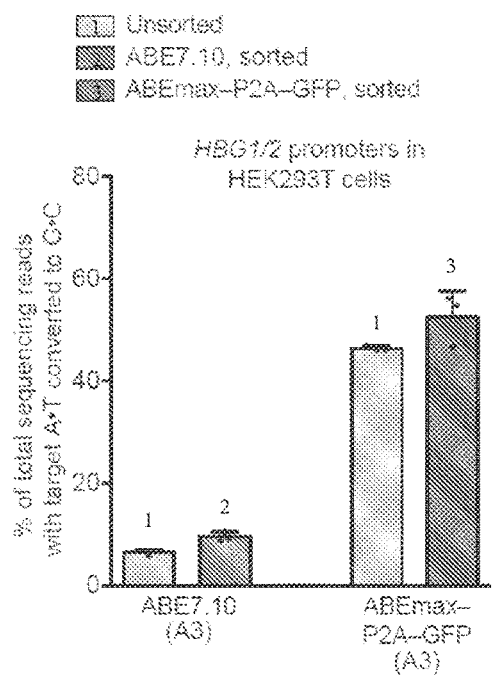
Figure 14C:
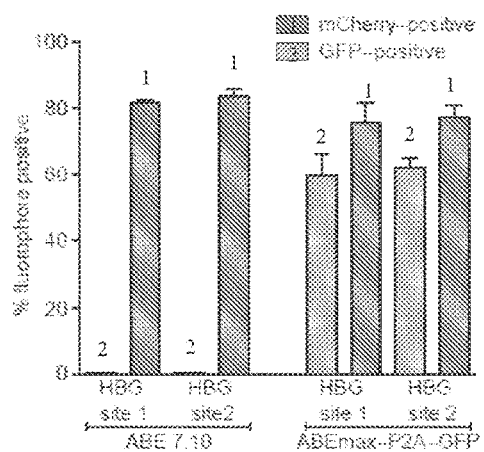

Finally, the activity of ABE 7.10 versus ABEmax was compared at two blood disease-associated targets. A number of genetic blood disorders, including sickle cell anemia and β-thalassemia, are driven by mutations in the β-globin gene. Activating mutations in the promoters of HBG1 or HBG2 (γ-globin) that are normally silenced after birth can rescue β-globin disorders[46]. Two sgRNAs were designed to install different activating mutations in γ-globin promoters. The first sgRNA should target ABE to introduce mutations at protospacer positions A5 and A8 (HBG promoter positions −116 and −113 relative to the transcription start site). The −116 A to G mutation may perturb the binding site for the γ-globin repressor Bcl11a[47], while the −113 A to G mutation should perturb this binding site and is also a naturally-occurring SNP that confers the hereditary persistence of fetal hemoglobin[48]. Once again, ABEmax substantially outperformed ABE 7.10, with both unsorted and sorted HEK293T cells treated with ABEmax resulting in approximately double the conversion efficiencies at A5 and A8 than unsorted and sorted cells treated with ABE 7.10 (FIG. 4C). For the second sgRNA, which installs the −175 T to C point mutation in the HBG promoter that is one of the strongest known HBG promoter SNPs upregulating fetal hemoglobin[48], 6.5±0.57% and 10±1.0% editing in unsorted and sorted HEK293T cells expressing ABE 7.10, was observed respectively, compared to 46±0.55% and 52±5.2% editing in unsorted and sorted cells expressing ABEmax, respectively (FIG. 4D). Thus ABEmax increased editing efficiency at the HBG-175T target by 5.2- to 7.1-fold over ABE 7.10. Notably, this mutation lies at position A3 of the protospacer, and thus is slightly outside the normal ABE editing window, demonstrating that ABEmax can support efficient editing of sites expected to be poor candidates for base editing by ABE 7.10. Transfection efficiencies for all tested conditions were measured by flow cytometry and were consistent across samples, indicating that outcomes were primarily dependent primarily on base editor expression and activity (FIG. 14C). Together, these results demonstrate that ABEmax substantially improves the efficiency of base editing at two loci relevant to human disease.

In summary, elucidation of factors that limit cytidine and adenine base editor efficiency resulted in optimization of nuclear localization and codon usage, as well as ancestral protein reconstruction, greatly improved the expression levels and editing efficiencies of both the BE4 C·G-to-T·A base editor and the ABE 7.10 A·T-to-G·C base editor. The editing performance improvements offered by BE4 max, AncBE4 max, and ABEmax extended to a variety of mammalian cell types across a number of previously unreported disease-relevant loci, as well as commonly tested loci. These improvements are especially pronounced when using base editors under sub-optimal conditions, such as those commonly found in some research and many therapeutic applications, or at sites that were previously edited with only modest efficiency. These developments greatly expand the capabilities of the current base editors for a wide range of applications, and BE4 max, AncBE4 max, and ABEmax are recommended for current base editing experiments.

Methods

General Methods. PCR was performed using either Phusion U Green Multiplex PCR Master Mix (ThermoFisher Scientific) or Q5 Host Start High-Fidelity 2× Master Mix (New England Biolabs) unless otherwise noted. All plasmids were assembled by either the USER cloning method as previously described[49] or by Gibson assembly[50]. Plasmids for mammalian cell transfections were prepared using an endotoxin removal plasmid purification system, ZymoPURE Plasmid Midiprep (Zymo Research Corporation).

Cell culture conditions. HEK293T cells (ATCC CRL-3216) were cultured in Dulbecco's Modified Eagle's Medium (DMEM, Corning) supplemented with 10% fetal bovine serum (FBS) and 5% penicillin streptomycin (Pen Strep, ThermoFisher Scientific). Fibroblast cell lines were maintained in DMEM supplemented with 15% FBS. N2a cells were maintained in DMEM supplemented with 10% FBS.

HEK293T transfection and genomic DNA preparation. HEK293T cells were seeded into 48-well Poly-D-Lysine coated plates (Corning) in the absence of Pen Strep antibiotic. 12-15 hours after plating, cells were transfected with 1 µL of Lipofectamine 2000 (ThermoFisher Scientific) using 750 ng of base editor plasmid, 250 ng of guide RNA plasmid, and 20 ng of fluorescent protein expression plasmid as a transfection control. Unless otherwise stated, cells were cultured for 3 days before they were washed with PBS (ThermoFisher Scientific). Genomic DNA was extracted by addition of 150 µL of freshly prepared lysis buffer (10 mM Tris-HCl, pH 7.5, 0.05% SDS, 25 µg/mL proteinase K (ThermoFisher Scientific)) directly into each transfected well. The resulting mixture was incubated for 1 hour at 37° C. before a 30-min enzyme inactivation step at 80° C. Guide RNA sequences for HEK2, HEK3, HEK4, RNF2, EMX1, Site 2, Site 5, Site 13, Site 16 were previously reported[2, 3, 6].

HEK293T base editing dose titrations. HEK293T cells were seeded as described above and transfected with a mixture of base editor plasmid, guide RNA plasmid, pUC, and GFP. 250 ng of guide RNA plasmid and 20 ng of GFP transfection control plasmid were used for all samples. Base editor and pUC plasmids were combined in different amounts to maintain a constant amount of total DNA per transfection.

Fluorescence-activated cell sorting. Flow cytometry analysis was carried out using an Aria Fortessa III. HEK293T cells were transfected with guide RNA expression plasmids, fluorophore expression plasmids, and editor expression plasmids. In trans samples were sorted for mCherry-positive cells. Both the in cis and P2A samples were sorted for both GFP and mCherry double-positive cells. A stringent mCherry-positive gate was used to avoid mCherry false positives. Over 15,000 cells were collected for each experimental sample. Genomic DNA for sorted and unsorted FACS samples was isolated using the Agencourt DNAdvance Genomic DNA Isolation Kit (Beckman Coulter) according to the manufacturer's instructions.

Nucleofection of fibroblasts and genomic DNA extraction. Cells were nucleofected using the Primary P2 Cell Line 4D-Nucleofector X Kit (Lonza) according to manufacturer's protocol. $1.25 \times 10^5$ cells were nucleofected in 20 µL of P2 buffer supplemented with 750 ng of editor, 250 ng of guide RNA plasmid, and 20 ng of mCherry nucleofection marker. Cells were nucleofected in a 16-well nucleocuvette strip using the DT-130 program. Following a 3-day incubation, cells were flow sorted and genomic DNA was extracted as described for HEK293T cells above.

High-throughput DNA sequencing (HTS) of genomic DNA. HTS of genomic DNA from HEK293T cells was perform as described previously[2, 3, 6]. For fibroblasts, 34 cycles of amplification were used for PCR1. Primers for PCR 1 of HEK2, HEK3, HEK4, RNF2, EMX1, ABE Site 2, ABE Site 5, ABE Site 13, ABE Site 16, and HBG loci were used as previously described[3, 6, 19]. PCR 1 primers for type 1F congenital glycosylation disorder, SCN9a, and all previously used loci are listed in Sequences 2 below.

General HTS analysis. Sequencing reads were demultiplexed using the MiSeq Reporter (Illumina) and Fastq files were analyzed using open source analysis tools. FASTQ files were aligned to the reference genome using the burrows-wheeler aligner (bwa-mem)[51]. Statistics for each base were calculated using the pysamstats utility available at github.com/alimanfoo/pysamstats. All reads for a given base were aligned to the reference sequence. Total reads were the sum of all base calls, insertions, and deletions at any given nucleotide position. Percent representation of each base was calculated as reads of a given base divided by total reads. Indel frequencies were quantified with a custom Matlab script as previously described[3, 20].

Quantitative RT-PCR and quantitative PCR. HEK293T cells were transfected with base editor-P2A-GFP plasmids and incubated 3 days before harvesting DNA and RNA from each sample. DNA samples were harvested using the genomic DNA preparation protocol described above. RNA was isolated and amplified using the Cells-to-Ct (Thermofisher) kit according to the manufacturer's protocol except the DNase treatment step used 2× DNase for twice as long to ensure complete degradation of plasmid DNA. Levels of mRNA were calculated by normalizing base editor mRNA levels to β-actin levels by ΔΔCt. Plasmid DNA levels were calculated to ensure that mRNA levels were not skewed by transfection efficiency. Plasmid DNA levels were calculated by normalizing amplification of the BGH polyadenylation present on the base editor plasmid to β-actin levels.

Western blotting. HEK293T cells were transfected with 750 ng of base editor-3×HA tag plasmid and 250 ng of guide RNA plasmid. After 3 days, cells were lysed using RIPA buffer with PMSF and cOmplete Protease Inhibitor Cocktail (Sigma-Aldrich). Samples were boiled and quantified using a BCA assay. 10 μg of protein was loaded per well into a 12-well 4-12% Tris gel (Novex). Blots were transferred to nitrocellulose paper for 7 min at 20 V before blocking and incubation with anti-HA (Cell Signaling Technology) and anti-Actin antibodies (Cell Signaling Technology). Blots were visualized using an Odyssey imager.

APOBEC sequence collection. APOBEC protein sequences used in phylogenetic analyses were identified through searches of the Uniprot database[52] with the BLASTP algorithm[53] using selected query sequences. All sequences from these searches that returned BLASTP E-values $<10^{-7}$ were downloaded from Uniprot. To reduce phylogenetic complexity, sequences were curated based on character length and pairwise sequence identity within each dataset. The dataset used for the construction of the non-redundant phylogeny was generated using four query sequences: UniProt IDs P41238, H2P4E7, E1BTD6, and H2P4E9. Multiple sequences were necessary to generate full coverage due to the low sequence identity across the family, which is <25% between some members. Limits were chosen to remove truncated and partial sequences and those featuring large insertions or terminal extensions. Sequences greater than 97% identical, determined by pairwise alignment within the dataset, were also removed. This level of identity provides a high level of detail within the tree while accelerating computational time by removing redundant taxa. The final dataset contains 468 taxa (Sequences 5 below).

Figure 15:
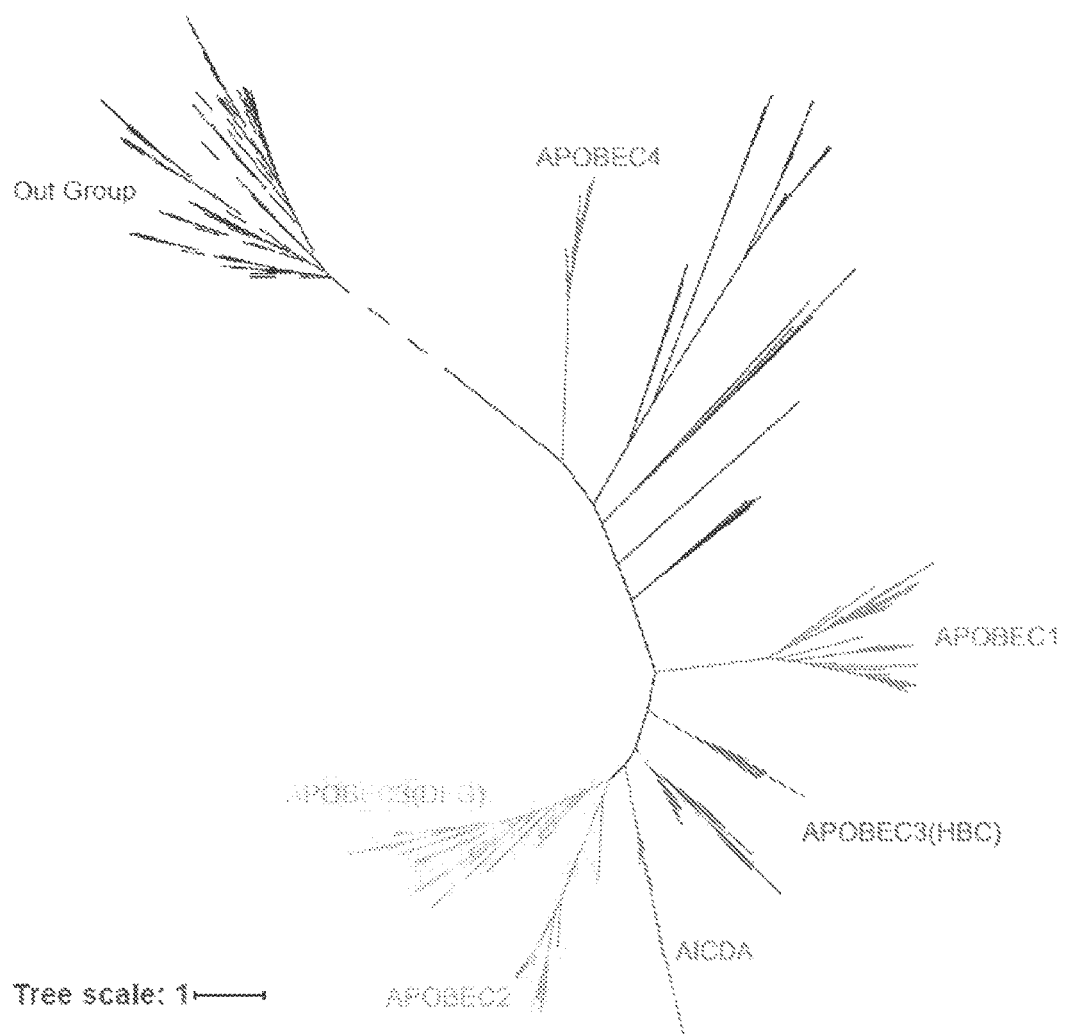
FIG. 15. 468—taxa unrooted phylogeny of APOBEC homologs. The tree is shaded according to the UNIPROT annotation of sequences within each clade. Dotted lines indicate sequences used as an outgroup to root the tree in FIG. 2C.

Phylogeny construction. A multiple sequence alignment of the dataset was generated with the program MAFFT using the FFT-NS-I x1000 algorithm[54]. Model selection used the Bayesian information criteria (BIC) to determine the evolutionary model that best fit the input alignment[55]. 228 models where tested. The Jones Taylor Thornton (JTT) substitution matrix with empirical frequencies (F) and free rates with five categories (R5) was the model that best fit the data. A maximum likelihood (ML) phylogenetic tree was inferred with IQ-TREE[56] using the best fit model (JTT+F+R5). The starting trees were generated by randomized maximum parsimony and searched by fast hill-climbing Nearest Neighbor Interchange (NNI). Tree topology, branch lengths, and rate parameters were optimized. Branch supports were estimated with Ultrafast boot strapping, implemented in IQ-TREE[57] (FIG. 15).

Ancestral sequence reconstruction. Sequences at internal nodes in the phylogeny were inferred using the codeml program from the PAML software packages[58]. Posterior amino acid probabilities at each site were calculated using the JTT substitution matrix, given the ML tree and estimated background frequencies generated by IQ-TREE. N- and C-termini of ancestral sequences were modified manually to match those of Rat APOBEC1.

Note 1. Python script to analyze pathogenic SNPs within the ClinVar database.

```
import numpy as np
import pandas as pd
# download latest ClinVar from //ftp.ncbi.nlm.nih.gov/pub/clinvar/tab_delimited/
# convert to csv
ClinVar=pd.read_csv('2018-04-23-variant_summary.csv')
# restrict to SNPs
ClinVar=ClinVar[ClinVar.Type=='single nucleotide variant']
# restrict to pathogenic
ClinVar=ClinVar
   [ClinVar.ClinicalSignificance=='Pathogenic']
# remove nans
ClinVar=ClinVar[ClinVar.ReferenceAllele !='na']
ClinVar=ClinVar[ClinVar.AlternateAllele !='na']
# drop duplicates of AlleleID
ClinVar=ClinVar.drop_duplicates('#AlleleID')
# total SNPs in ClinVar
total_SNPs=len(ClinVar)
def SNP_count(cv, ref, alt):
   ClinVar_ref=cv[cv.ReferenceAllele==ref]
   ClinVar_ref_alt=ClinVar_ref
      [ClinVar_ref.AlternateAllele==alt]
   return len(ClinVar_ref alt)
counts=np.array([['', 'A', 'T', 'G', 'C'],
   ['A', 0, SNP_count(ClinVar, 'A', 'T'), SNP_count(ClinVar, 'A', 'G'), SNP_count(ClinVar, 'A', 'C')],
   ['T', SNP_count(ClinVar, 'T', 'A'), 0, SNP_count(ClinVar, 'T', 'G'), SNP_count(ClinVar, 'T', 'C')],
   ['G', SNP_count(ClinVar, 'G', 'A'), SNP_count(ClinVar, 'G', 'T'), 0, SNP_count(ClinVar, 'G', 'C')],
   ['C', SNP_count(ClinVar, 'C', 'A'), SNP_count(ClinVar, 'C', 'T'), SNP_count(ClinVar, 'C', 'G'), 0]])
np. savetxt('ClinVar_SNPs.csv', counts, fmt='%5s', delimiter=',')
```

Sequences 1. Target Protospacer Sequences Used in this Study.

Target Cs and As are bold, with a subscripted number denoting spacer position. PAM sequences are italicized.

| | | |
|---|---|---|
| HEK293_site | GAAC$_4$AC$_6$AAAGCATAGACTGC*GGG* | SEQ ID NO: 150 |
| HEK293_site 3 | GGC$_4$C$_5$AGACTGAGCACGTGA*TGG* | SEQ ID NO: 151 |
| HEK293_site | GGCAC$_5$TGCGGCTGGAGGTCC*GGG* | SEQ ID NO: 152 |
| RNF2 | GTCATC$_6$TTAGTCATTACCTGA*GG* | SEQ ID NO: 153 |
| EMX1 | GAGTC$_5$C$_6$GAGCAGAAGAAGAA*GGG* | SEQ ID NO: 154 |
| SCN9a | GTTAGTC$_7$C$_8$TTAAAATGTAGGG*GGG* | SEQ ID NO: 155 |
| MPDU1 | GTTC$_4$C$_5$C$_6$GGTC$_{10}$ATGCACTACAG *AGG* | SEQ ID NO: 156 |
| ABE_site 2 | GAGTA$_5$TGA$_7$GGCATAGACTGC*AGG* | SEQ ID NO: 157 |

```
ABE_site 5    GATGA5GA7TAATGATGAGTCAGGG    SEQ ID NO:
                                           158

ABE_site 13   GAAGA5TA7GAGAATAGACTGCTGG    SEQ ID NO:
                                           159

ABE_site 16   GGGA4A5TA7AATCATAGAATCCTGG   SEQ ID NO:
                                           160

HBG_site 1    CTTGA5CCA8A9TA11GCCTTGACAA   SEQ ID NO:
              GG                           161

HBG_site 2    A1TA3TTTGCA9TTGA13GATAGTGT   SEQ ID NO:
              GG                           162
```

Sequences 2. Primers Used in this Study.

All oligonucleotides were purchased from Integrated DNA Technologies (IDT).

Primers Used for Generating sgRNA Plasmids

The MPDU1 guide plasmid was cloned by digesting a modified version of pFYF1320[1] in which BsmBI restriction cut sites were installed via KLD cloning. The primers below were phosphorylated and annealed to enable ligation into BsmBI cut backbone. All guides were designed to include a 5'-G to enable transcription from the hU6 transcription. CCACC was included at the 5' end of the forward primer, and AAAC was included at the 5' end of the reverse primer to complement the overhands generated by restriction digest. The HEK2, HEK3, HEK4, RNF2, EMX1, ABE site 2, ABE site 5, ABE site 13, ABE site 16, SCN9a, HBG site 1, HBG site 2 sgRNAs were prepared by KLD cloning as previously described[2] using the primers listed below.

Primers for MPDU1 sgRNA

JLD 85
(SEQ ID NO: 163)
CACCGTTCCCGGTCATGCACTACAG

JLD 86
(SEQ ID NO: 164)
AAACCTGTAGTGCATGACCGGGAAC

Primers for SCN9a, HBG site 1, HBG site 2, and previously used sgRNAs (SEQ ID NO: 165)
Universal reverse primer GGTGTTTCGTCCTTTCCACAAG fwd_HEK293_site 2
(SEQ ID NO: 166)
GAACACAAAGCATAGACTGCGTTTTAGAGCTAGAAATAGCAAGTTAAAAT
AAGGC fwd_HEK293_site 3
(SEQ ID NO: 167)
GGCCCAGACTGAGCACGTGAGTTTTAGAGCTAGAAATAGCAAGTTAAAAT
AAGGC fwd_HEK293_site 4
(SEQ ID NO: 168)
GGCACTGCGGCTGGAGGTGGGTTTTAGAGCTAGAAATAGCAAGTTAAAAT
AAGGC fwd_RNF2
(SEQ ID NO: 169)
GTCATCTTAGTCATTACCTGGTTTTAGAGCTAGAAATAGCAAGTTAAAAT
AAGGC fwd_EMX1
(SEQ ID NO: 170)
GAGTCCGAGCAGAAGAAGAAGTTTTAGAGCTAGAAATAGCAAGTTAAAAT
AAGGC fwd_ABE_site 2
(SEQ ID NO: 171)
GAGTATGAGGCATAGACTGCGTTTTAGAGCTAGAAATAGCAAGTTAAAAT
AAGGC fwd_ABE_site 5
(SEQ ID NO: 172)
GATGAGATAATGATGAGTCAGTTTTAGAGCTAGAAATAGCAAGTTAAAAT
AAGGC fwd_ABE_site 13
(SEQ ID NO: 173)
GAAGATAGAGAATAGACTGCGTTTTAGAGCTAGAAATAGCAAGTTAAAAT
AAGGC fwd_ABE_site 16
(SEQ ID NO: 174)
GGGAATAAATCATAGAATCCGTTTTAGAGCTAGAAATAGCAAGTTAAAAT
AAGGC fwd_SCN9a
(SEQ ID NO: 175)
GTTAGTCCTTAAAATGTAGGGGTTTTAGAGCTAGAAATAGCAAGTTAAAA
TAAGGC fwd_HBG_site 1
(SEQ ID NO: 176)
GCTTGACCAATAGCCTTGACAGTTTTAGAGCTAGAAATAGCAAGTTAAAA
TAAGGC fwd_HBG_site 2
(SEQ ID NO: 177)
GATATTTGCATTGAGATAGTGGTTTTAGAGCTAGAAATAGCAAGTTAAAA
TAAGGC

Primers to amplify genomic loci for HTS of mammalian cell culture experiments SCN9a HTS Fwd
(SEQ ID NO: 178)
ACACTCTTTCCCTACACGACGCTCTTCCGATCTNNNNGCGAACACACTGA
GACAGAAC SCN9a HTS Rev
(SEQ ID NO: 179)
TGGAGTTCAGACGTGTGCTCTTCCGATCT GCACTCCTAGTTAGGCTTGT
G Type 1f HTS Fwd
(SEQ ID NO: 180)
ACACTCTTTCCCTACACGACGCTCTTCCGATCTNNNNGTCCCTGGATGGA
TGGGCTATGG Type 1f HTS Rev
(SEQ ID NO: 181)
TGGAGTTCAGACGTGTGCTCTTCCGATCTGGCTTTCCCAGACCTGAGTTC
CC HBG HTS Fwd
(SEQ ID NO: 182)
ACACTCTTTCCCTACACGACGCTCTTCCGATCTNNNNCCTGGCCTCACT
GGATACTC HBG HTS Rev
(SEQ ID NO: 183)
TGGAGTTCAGACGTGTGCTCTTCCGATCTCTGACAAAAGAAGTCCTGGTA
TC fwd_HEK293_site 2_HTS
(SEQ ID NO: 184)
ACACTCTTTCCCTACACGACGCTCTTCCGATCTNNNNCCAGCCCCATCTG
TCAAACT rev_HEK293_site 2_HTS
(SEQ ID NO: 185)
TGGAGTTCAGACGTGTGCTCTTCCGATCTTGAATGGATTCCTTGGAAACA
ATGA fwd_HEK293_site_3_HTS (SEQ ID NO: 186)
ACACTCTTTCCCTACACGACGCTCTTCCGATCTNNNNATGTGGGCTGCCT
AGAAAGG rev_HEK293_site_3_HTS (SEQ ID NO: 187)
TGGAGTTCAGACGTGTGCTCTTCCGATCTCCCAGCCAAACTTGTCAACC fwd_HEK293_site_4_HTS (SEQ ID NO: 188)
ACACTCTTTCCCTACACGACGCTCTTCCGATCTNNNNGAACCCAGGTAGC
CAGAGAC rev_HEK293_site_4_HTS (SEQ ID NO: 189)
TGGAGTTCAGACGTGTGCTCTTCCGATCTTCCTTTCAACCCGAACGGAG fwd_RNF2_HTS (SEQ ID NO: 190)
ACACTCTTTCCCTACACGACGCTCTTCCGATCTNNNNACGTCTCATATGC
CCCTTGG rev_RNF2_HTS (SEQ ID NO: 191)
TGGAGTTCAGACGTGTGCTCTTCCGATCTACGTAGGAATTTTGGTGGGAC
A fwd_EMX1_HTS (SEQ ID NO: 192)
ACACTCTTTCCCTACACGACGCTCTTCCGATCTNNNNCAGCTCAGCCTGA
GTGTTGA rev_EMX1_HTS (SEQ ID NO: 193)
TGGAGTTCAGACGTGTGCTCTTCCGATCTCTCGTGGGTTTGTGGTTGC fwd_ABE_site_2_HTS (SEQ ID NO: 194)
ACACTCTTTCCCTACACGACGCTCTTCCGATCTNNNNAGAGACTGATTGC
GTGGAGT rev_ABE_site_2_HTS (SEQ ID NO: 195)
TGGAGTTCAGACGTGTGCTCTTCCGATCTCACTCCAGCCTAGGCAACAA fwd_ABE_site_5_HTS (SEQ ID NO: 196)
ACACTCTTTCCCTACACGACGCTCTTCCGATCTNNNNGTCTGAGGTCACA
CAGTGGG rev_ABE_site_5_HTS (SEQ ID NO: 197)
TGGAGTTCAGACGTGTGCTCTTCCGATCTCTGAGAGCAGGGACCACATC fwd_ABE_site_13_HTS (SEQ ID NO: 198)
ACACTCTTTCCCTACACGACGCTCTTCCGATCTNNNNTCACTTCAGCCCA
GGAGTAT rev_ABE_site_13_HTS (SEQ ID NO: 199)
TGGAGTTCAGACGTGTGCTCTTCCGATCTTCTCTTTCTCTCCCCCACCC fwd_ABE_site_16_HTS (SEQ ID NO: 200)
ACACTCTTTCCCTACACGACGCTCTTCCGATCTNNNNGGGAGGTGGAGAG
AGGATGT rev_ABE_site_16_HTS (SEQ ID NO: 201)
TGGAGTTCAGACGTGTGCTCTTCCGATCTTCCTGAGGTCTAGGAACCCG Sequences 3. Amino Acid Sequences of BE4, rAPOBEC1, Ancestral APOBECs, ABE, and P2A-GFP.

Within base editor sequences, NLS sequences are bold, APOBEC and TadA sequences are italicized, linkers are double underlined, Cas9 nickase sequence is underlined, and UGI sequences are bold and italicized.

BE4 max and AncBE4 max (SEQ ID NO: 202)

MKRTADGSEFESPKKKRKV_[APOBEC]_SGGSSGGSSGSETPGTSESATPESSGGSS

GGS_DKKYSIGLAIGTNSVGWAVITDEYKVPSKKFKVLGNTDRHSIKKNLIGALLFDS

GETAEATRLKRTARRRYTRRKNRICYLQEIFSNEMAKVDDSFFHRLEESFLVEEDKK

HERHPIFGNIVDEVAYHEKYPTIYHLRKKLVDSTDKADLRLIYLALAHMIKFRGHFLI

EGDLNPDNSDVDKLFIQLVQTYNQLFEENPINASGVDAKAILSARLSKSRRLENLIAQ

LPGEKKNGLFGNLIALSLGLTPNFKSNFDLAEDAKLQLSKDTYDDDLDNLLAQIGDQ

YADLFLAAKNLSDAILLSDILRVNTEITKAPLSASMIKRYDEHHQDLTLLKALVRQQL

PEKYKEIFFDQSKNGYAGYIDGGASQEEFYKFIKPILEKMDGTEELLVKLNREDLLRK

QRTFDNGSIPHQIHLGELHAILRRQEDFYPFLKDNREKIEKILTFRIPYYVGPLARGNS

RFAWMTRKSEETITPWNFEEVVDKGASAQSFIERMTNFDKNLPNEKVLPKHSLLYEY

FTVYNELTKVKYVTEGMRKPAFLSGEQKKAIVDLLFKTNRKVTVKQLKEDYFKKIE

CFDSVEISGVEDRFNASLGTYHDLLKIIKDKDFLDNEENEDILEDIVLTLTLFEDREMIE

ERLKTYAHLFDDKVMKQLKRRRYTGWGRLSRKLINGIRDKQSGKTILDFLKSDGFA

NRNFMQLIHDDSLTFKEDIQKAQVSGQGDSLHEHIANLAGSPAIKKGILQTVKVVDE

LVKVMGRHKPENIVIEMARENQTTQKGQKNSRERMKRIEEGIKELGSQILKEHPVEN

TQLQNEKLYLYYLQNGRDMYVDQELDINRLSDYDVDHIVPQSFLKDDSIDNKVLTR

SDKNRGKSDNVPSEEVVKKMKNYWRQLLNAKLITQRKFDNLTKAERGGLSELDKA

-continued

```
GFIKRQLVETRQITKHVAQILDSRMNTKYDENDKLIREVKVITLKSKLVSDFRKDFQF
YKVREINNYHHAHDAYLNAVVGTALIKKYPKLESEFVYGDYKVYDVRKMIAKSEQ
EIGKATAKYFFYSNIMNFFKTEITLANGEIRKRPLIETNGETGEIVWDKGRDFATVRK
VLSMPQVNIVKKTEVQTGGFSKESILPKRNSDKLIARKKDWDPKKYGGFDSPTVAYS
VLVVAKVEKGKSKKLKSVKELLGITIMERSSFEKNPIDFLEAKGYKEVKKDLIIKLPK
YSLFELENGRKRMLASAGELQKGNELALPSKYVNFLYLASHYEKLKGSPEDNEQKQ
LFVEQHKHYLDEIIEQISEFSKRVILADANLDKVLSAYNKHRDKPIREQAENIIHLFTLT
NLGAPAAFKYFDTTIDRKRYTSTKEVLDATLIHQSITGLYETRIDLSQLGGD SGGSG
GSGGS TNLSDIIEKETGKQLVIQESILMLPEEVEEVIGNKPESDILVHTAYDESTDEN
VMLLTSDAPEYKPWALVIQDSNGENKIKML SGGSGGSGGS TNLSDIIEKETGKQLV
IQESILMLPEEVEEVIGNKPESDILVHTAYDESTDENVMLLTSDAPEYKPWALVIQDS
NGENKIKML SGGS KRTADGSEFEPKKKRKV [optional P2A-GFP]
```

The portion indicated by [APOBEC] in the above sequence of SEQ ID NO 202 may include any APOBEC sequence, or variant thereof, provided herein. For example, in some embodiments, the [APOBEC] may comprise any one of SEQ ID NOs: 4-9, 203-209, or 220-687.

Exemplary BE4 max(with Nickase):

(SEQ ID NO: 693)
```
MKRTADGSEFESPKKKRKVSSETGPVAVDPTLRRRIEPHEFEVFFDPRE
LRKETCLLYEINWGGRHSIWRHTSQNTNKHVEVNFIEKFTTERYFCPNT
RCSITWFLSWSPCGECSRAITEFLSRYPHVTLFIYIARLYHHADPRNRQ
GLRDLISSGVTIQIMTEQESGYCWRNFVNYSPSNEAHWPRYPHLWVRLY
VLELYCIILGLPPCLNILRRKQPQLTFFTIALQSCHYQRLPPHILWATG
LKSGGSSGGSSGSETPGTSESATPESSGGSSGGSDKKYSIGLAIGTNSV
GWAVITDEYKVPSKKFKVLGNTDRHSIKKNLIGALLFDSGETAEATRLK
RTARRRYTRRKNRICYLQEIFSNEMAKVDDSFFHRLEESFLVEEDKKHE
RHPIFGNIVDEVAYHEKYPTIYHLRKKLVSTDKADLRLIYLALAHMIK
FRGHFLIEGDLNPDNSDVDKLFIQLVQTYNQLFEENPINASGVDAKAIL
SARLSKSRRLENLIAQLPGEKKNGLFGNLIALSLGLTPNFKSNFDLAED
AKLQLSKDTYDDDLDNLLAQIGDQYADLFLAAKNLSDAILLSDILRVNT
EITKAPLSASMIKRYDEHHQDLTLLKALVRQQLPEKYKEIFFDQSKNGY
AGYIDGGASQEEFYKFIKPILEKMDGTEELLVKLNREDLLRKQRTFDNG
SIPHQIHLGELHAILRRQEDFYPFLKDNREKIEKILTFRIPYYVGPLAR
GNSRFAWMTRKSEETITPWNFEEVVDKGASAQSFIERMTNFDKNLPNEK
VLPKHSLLYEYFTVYNELTKVKYVTEGMRKPAFLSGEQKKAIVDLLFKT
```

-continued
```
NRKVTVKQLKEDYFKKIECFDSVEISGVEDRFNASLGTYHDLLKIIKDK
DFLDNEENEDILEDIVLTLTLFEDREMIEERLKTYAHLFDDKVMKQLKR
RRYTGWGRLSRKLINGIRDKQSGKTILDFLKSDGFANRNFMQLIHDDSL
TFKEDIQKAQVSGQGDSLHEHIANLAGSPAIKKGILQTVKVVDELVKVM
GRHKPENIVIEMARENQTTQKGQKNSRERMKRIEEGIKELGSQILKEHP
VENTQLQNEKLYLYYLQNGRDMYVDQELDINRLSDYDVDHIVPQSFLKD
DSIDNKVLTRSDKNRGKSDNVPSEEVVKKMKNYWRQLLNAKLITQRKFD
NLTKAERGGLSELDKAGFIKRQLVETRQITKHVAQILDSRMNTKYDEND
KLIREVKVITLKSKLVSDFRKDFQFYKVREINNYHHAHDAYLNAVVGTA
LIKKYPKLESEFVYGDYKVYDVRKMIAKSEQEIGKATAKYFFYSNIMNF
FKTEITLANGEIRKRPLIETNGETGEIVWDKGRDFATVRKVLSMPQVNI
VKKTEVQTGGFSKESILPKRNSDKLIARKKDWDPKKYGGFDSPTVAYSV
LVVAKVEKGKSKKLKSVKELLGITIMERSSFEKNPIDFLEAKGYKEVKK
DLIIKLPKYSLFELENGRKRMLASAGELQKGNELALPSKYVNFLYLASH
YEKLKGSPEDNEQKQLFVEQHKHYLDEIIEQISEFSKRVILADANLDKV
LSAYNKHRDKPIREQAENIIHLFTLTNLGAPAAFKYFDTTIDRKRYTST
KEVLDATLIHQSITGLYETRIDLSQLGGDSGGSGGSGGSTNLSDIIEKE
TGKQLVIQESILMLPEEVEEVIGNKPESDILVHTAYDESTDENVMLLTS
DAPEYKPWALVIQDSNGENKIKMLSGGSGGSGGSTNLSDIIEKETGKQL
VIQESILMLPEEVEEVIGNKPESDILVHTAYDESTDENVMLLTSDAPEY
KPWALVIQDSNGENKIKMLSGGSKRTADGSEFEPKKKRKV
```

Exemplary BE4 Sequence:

(SEQ ID NO:688)
```
MSSETG PVAVDPTLRR RIEPHEFEVF FDPRELRKET
CLLYEINWGGRHSIWRHTSQ NTNKHVEVNF IEKFTTERYF CPNTRCSITW
FLSWSPCGEC SRAITEFLSRYPHVTLFIYI ARLYHHADPR NRQGLRDLIS
SGVTIQIMTE QESGYCWRNF VNYSPSNEAH WPRYPHLWVR LYVLELYCII
```

-continued

```
LGLPPCLNIL RRKQPQLTFF TIALQSCHYQ RLPPHILWAT GLKSGGSSGG

SSGSETPGTS ESATPESSGG SSGGSDKKYS IGLAIGTNSV GWAVITDEYK

VPSKKFKVLG NTDRHSIKKN LIGALLFDSG ETAEATRLKR TARRRYTRRK

NRICYLQEIF SNEMAKVDDS FFHRLEESFL VEEDKKHERH PIFGNIVDEV

AYHEKYPTIY HLRKKLVDST DKADLRLIYL ALAHMIKFRG HFLIEGDLNP

DNSDVDKLFI QLVQTYNQLF EENPINASGV DAKAILSARL SKSRRLENLI

AQLPGEKKNG LFGNLIALSL GLTPNFKSNF DLAEDAKLQL SKDTYDDDLD

NLLAQIGDQY ADLFLAAKNL SDAILLSDIL RVNTEITKAP LSASMIKRYD

EHHQDLTLLK ALVRQQLPEK YKEIFFDQSK NGYAGYIDGG ASQEEFYKFI

KPILEKMDGT EELLVKLNRE DLLRKQRTFD NGSIPHQIHL GELHAILRRQ

EDFYPFLKDN REKIEKILTF RIPYYVGPLA RGNSRFAWMT RKSEETITPW

NFEEVVDKGA SAQSFIERMT NFDKNLPNEK VLPKHSLLYE YFTVYNELTK

VKYVTEGMRK PAFLSGEQKK AIVDLLFKTN RKVTVKQLKE DYFKKIECFD

SVEISGVEDR FNASLGTYHD LLKIIKDKDF LDNEENEDIL EDIVLTLTLF

EDREMIEERL KTYAHLEDDK VMKQLKRRRY TGWGRLSRKL INGIRDKQSG

KTILDFLKSD GFANRNFMQL IHDDSLTFKE DIQKAQVSGQ GDSLHEHIAN

LAGSPAIKKG ILQTVKVVDE LVKVMGRHKP ENIVIEMARE NQTTQKGQKN

SRERMKRIEE GIKELGSQIL KEHPVENTQL QNEKLYLYYL QNGRDMYVDQ

ELDINRLSDY DVDHIVPQSF LKDDSIDNKV LTRSDKNRGK SDNVPSEEVV

KKMKNYWRQL LNAKLITQRK FDNLTKAERG GLSELDKAGF IKRQLVETRQ

ITKHVAQILD SRMNTKYDEN DKLIREVKVI TLKSKLVSDF RKDFQFYKVR

EINNYHHAHD AYLNAVVGTA LIKKYPKLES EFVYGDYKVY DVRKMIAKSE

QEIGKATAKY FFYSNIMNFF KTEITLANGE IRKRPLIETN GETGEIVWDK

GRDFATVRKV LSMPQVNIVK KTEVQTGGFS KESILPKRNS DKLIARKKDW

DPKKYGGFDS PTVAYSVLVV AKVEKGKSKK LKSVKELLGI TIMERSSFEK

NPIDFLEAKG YKEVKKDLII KLPKYSLFEL ENGRKRMLAS AGELQKGNEL

ALPSKYVNFL YLASHYEKLK GSPEDNEQKQ LFVEQHKHYL DEIIEQISEF

SKRVILADAN LDKVLSAYNK HRDKPIREQA ENIIHLFTLT NLGAPAAFKY

FDTTIDRKRY TSTKEVLDAT LIHQSITGLY ETRIDLSQLG GDSGGSGGSG

GSTNLSDIIE KETGKQLVIQ ESILMLPEEV EEVIGNKPES DILVHTAYDE

STDENVMLLT SDAPEYKPWA LVIQDSNGEN KIKMLSGGSG GSGGSTNLSD

IIEKETGKQL VIQESILMLP EEVEEVIGNK PESDILVHTA YDESTDENVM

LLTSDAPEYK PWALVIQDSN GENKIKMLSG GSPKKKRK
```

Exemplary BE4 Sequence with His Tag:

```
                              (SEQ ID NO: 689)
MHHHHHHHHGSGGSGSSETGPVAVDPTLRRRIEPHEFEVFFDPRELRKET

CLLYEINWGGRHSIWRHTSQ NTNKHVEVNF IEKFTTERYF CPNTRCSITW

FLSWSPCGEC SRAITEFLSRYPHVTLFIYI ARLYHHADPR NRQGLRDLIS

SGVTIQIMTE QESGYCWRNF VNYSPSNEAH WPRYPHLWVR LYVLELYCII

LGLPPCLNIL RRKQPQLTFF TIALQSCHYQ RLPPHILWAT GLKSGGSSGG
```

-continued

```
SSGSETPGTS ESATPESSGG SSGGSDKKYS IGLAIGTNSV GWAVITDEYK

VPSKKFKVLG NTDRHSIKKN LIGALLEDSG ETAEATRLKR TARRRYTRRK

NRICYLQEIF SNEMAKVDDS FFHRLEESFL VEEDKKHERH PIFGNIVDEV

AYHEKYPTIY HLRKKLVDST DKADLRLIYL ALAHMIKFRG HFLIEGDLNP

DNSDVDKLFI QLVQTYNQLF EENPINASGV DAKAILSARL SKSRRLENLI

AQLPGEKKNG LFGNLIALSL GLTPNFKSNF DLAEDAKLQL SKDTYDDDLD

NLLAQIGDQY ADLFLAAKNL SDAILLSDIL RVNTEITKAP LSASMIKRYD

EHHQDLTLLK ALVRQQLPEK YKEIFFDQSK NGYAGYIDGG ASQEEFYKFI

KPILEKMDGT EELLVKLNRE DLLRKQRTFD NGSIPHQIHL GELHAILRRQ

EDFYPFLKDN REKIEKILTF RIPYYVGPLA RGNSRFAWMT RKSEETITPW

NFEEVVDKGA SAQSFIERMT NFDKNLPNEK VLPKHSLLYE YFTVYNELTK

VKYVTEGMRK PAFLSGEQKK AIVDLLFKTN RKVTVKQLKE DYFKKIECFD

SVEISGVEDR FNASLGTYHD LLKIIKDKDF LDNEENEDIL EDIVLTLTLF

EDREMIEERL KTYAHLEDDK VMKQLKRRRY TGWGRLSRKL INGIRDKQSG

KTILDFLKSD GFANRNFMQL IHDDSLTFKE DIQKAQVSGQ GDSLHEHIAN

LAGSPAIKKG ILQTVKVVDE LVKVMGRHKP ENIVIEMARE NQTTQKGQKN

SRERMKRIEE GIKELGSQIL KEHPVENTQL QNEKLYLYYL QNGRDMYVDQ

ELDINRLSDY DVDHIVPQSF LKDDSIDNKV LTRSDKNRGK SDNVPSEEVV

KKMKNYWRQL LNAKLITQRK FDNLTKAERG GLSELDKAGF IKRQLVETRQ

ITKHVAQILD SRMNTKYDEN DKLIREVKVI TLKSKLVSDF RKDFQFYKVR

EINNYHHAHD AYLNAVVGTA LIKKYPKLES EFVYGDYKVY DVRKMIAKSE

QEIGKATAKY FFYSNIMNFF KTEITLANGE IRKRPLIETN GETGEIVWDK

GRDFATVRKV LSMPQVNIVK KTEVQTGGFS KESILPKRNS DKLIARKKDW

DPKKYGGFDS PTVAYSVLVV AKVEKGKSKK LKSVKELLGI TIMERSSFEK

NPIDFLEAKG YKEVKKDLII KLPKYSLFEL ENGRKRMLAS AGELQKGNEL

ALPSKYVNFL YLASHYEKLK GSPEDNEQKQ LFVEQHKHYL DEIIEQISEF

SKRVILADAN LDKVLSAYNK HRDKPIREQA ENIIHLFTLT NLGAPAAFKY

FDTTIDRKRY TSTKEVLDAT LIHQSITGLY ETRIDLSQLG GDSGGSGGSG

GSTNLSDIIE KETGKQLVIQ ESILMLPEEV EEVIGNKPES DILVHTAYDE

STDENVMLLT SDAPEYKPWA LVIQDSNGEN KIKMLSGGSG GSGGSTNLSD

IIEKETGKQL VIQESILMLP EEVEEVIGNK PESDILVHTA YDESTDENVM

LLTSDAPEYK PWALVIQDSN GENKIKMLSG GSPKKKRK
```

Rat APOBEC1

(SEQ ID NO: 203)
```
SSETGPVAVDPTLRRRIEPHEFEVFFDPRELRKETCLLYEINWGGRHSI

WRHTSQNTNKHVEVNFIEKFTTERYFCPNTRCSITWFLSWSPCGECSRA

ITEFLSRYPHVTLFIYIARLYHHADPRNRQGLRDLISSGVTIQIMTEQE

SGYCWRNFVNYSPSNEAHWPRYPHLWVRLYVLELYCIILGLPPCLNILR

RKQPQLTFFTIALQSCHYQRLPPH ILWATGLK
```

Anc689 APOBEC (SEQ ID NO: 204)
```
SSETGPVAVDPTLRRRIEPHEFEVFFDPRELRKETCLLYEIKWGTSHKI

WRHSSKNTTKHVEVNFIEKFTSERHFCPSTSCSITWFLSWSPCGECSKA

ITEFLSQHPNVTLVIYVARLYHHMDQQNRQGLRDLVNSGVTIQIMTAPE

YDYCWRNFVNYPPGKEAHWPRYPPLWMKLYALELHAGILGLPPCLNILR

RKQPQLTFFTIALQSCHYQRLP PHILWATGLK
```

Anc687 APOBEC (SEQ ID NO: 205)
SSETGPVAVDPTLRRRIEPHEFEVFFDPRELRKEACLLYEIKWGTSHKI
WRNSGKNTTKHVEVNFIEKFTSERHFCPSISCSITWFLSWSPCWECSKA
IREFLSQHPNVTLVIYVARLFQHMDQQNRQGLRDLVNSGVTIQIMTASE
YDHCWRNFVNYPPGKEAHWPRYPPLWMKLYALELHAGILGLPPCLNILR
RKQPQLTFFTIALQSCHYQRLP PHILWATGLK

Anc686 APOBEC (SEQ ID NO: 206)
SSETGPVAVDPTLRRRIEPEFFNRNYDPRELRKETYLLYEIKWGKESKI
WRHTSNNRTQHAEVNFLENFFNELYFNPSTHCSITWFLSWSPCGECSKA
IVEFLKEHPNVNLEIYVARLYLCEDERNRQGLRDLVNSGVTIRIMNLPD
YNYCWRTFVSHQGGDEDYWPRHFAPWVRLYVLELYCIILGLPPCLNILR
RKQPQLTFFTIALQSCHYQRLPPHILWATGLK

Anc655 APOBEC (SEQ ID NO: 207)
SSETGPVAVDPTLRRRIEPFYFQFNNDPRACRRKTYLCYELKQDGSTWV
WKRTLHNKGRHAEICFLEKISSLEKLDPAQHYRITWYMSWSPCSNCAQK
IVDFLKEHPHVNLRIYVARLYYHEEERYQEGLRNLRRSGVSIRVMDLPD
FEHCWETFVDNGGGPFQPWPGLEELNSKQLSRRLQAGILGLPPCLNILR
RKQPQLTFFTIALQSCHYQR LPPHILWATGLK

Anc733 APOBEC (SEQ ID NO: 208)
SSETGPVAVDPTLRRRIEPFHFQFNNDPRAYRRKTYLCYELKQDGSTWV
LDRTLRNKGRHAEICFLDKINSWERLDPAQHYRVTWYMSWSPCSNCAQQ
VVDFLKEHPHVNLRIFAARLYYHEQRRYQEGLRSLRGSGVPVAVMTLPD
FEHCWETFVDHGGRPFQPWDGLEELNSRSLSRRLQAGILGLPPCLNILR
RKQPQLTFFTIALQSCHYQRLPPHILWATGLK

P2A-GFP (SEQ ID NO: 209)
GSGATNFSLLKQAGDVEENPGP_MVSKGEELFTGVVPILVELDGDVNGHK
FSVSGEGEGDATYGKLTLKFICTTGKLPVPWPTLVTTLTYGVQCFSRYPD
HMKQHDFFKSAMPEGYVQERTIFFKDDGNYKTRAEVKFEGDTLVNRIELK
GIDFKEDGNILGHKLEYNYNSHNVYIMADKQKNGIKVNFKIRHNIEDGSV
QLADHYQQNTPIGDGPVLLPDNHYLSTQSALSKDPNEKRDHMVLLEFVTA
AGITLGMDELYKSGGSPKKKRV

Exemplary ABE7.10 with His Tag:

(SEQ ID NO: 690)
MHHHHHHHHG SGGSGSEVEF SHEYWMRHAL TLAKRAWDER
EVPVGAVLVH NNRVIGEGWN RPIGRHDPTA HAEIMALRQG
GLVMQNYRLI DATLYVTLEP CVMCAGAMIH SRIGRVVFGA
RDAKTGAAGS LMDVLHHPGM NHRVEITEGI LADECAALLS
DFFRMRRQEI KAQKKAQSST DSGGSSGGSS GSETPGTSES
ATPESSGGSS GGSSEVEFSH EYWMRHALTL AKRARDEREV
PVGAVLVLNN RVIGEGWNRA IGLHDPTAHA EIMALRQGGL
VMQNYRLIDA TLYVTFEPCV MCAGAMIHSR IGRVVFGVRN
AKTGAAGSLM DVLHYPGMNH RVEITEGILA DECAALLCYF
FRMPRQVFNA QKKAQSSTDS GGSSGGSSGS ETPGTSESAT
PESSGGSSGG SDKKYSIGLA IGTNSVGWAV ITDEYKVPSK
KFKVLGNTDR HSIKKNLIGA LLFDSGETAE ATRLKRTARR
RYTRRKNRIC YLQEIFSNEM AKVDDSFFHR LEESFLVEED
KKHERHPIFG NIVDEVAYHE KYPTIYHLRK KLVDSTDKAD
LRLIYLALAH MIKFRGHFLI EGDLNPDNSD VDKLFIQLVQ
TYNQLFEENP INASGVDAKA ILSARLSKSR RLENLIAQLP
GEKKNGLFGN LIALSLGLTP NFKSNFDLAE DAKLQLSKDT
YDDDLDNLLA QIGDQYADLF LAAKNLSDAI LLSDILRVNT
EITKAPLSAS MIKRYDEHHQ DLTLLKALVR QQLPEKYKEI
FFDQSKNGYA GYIDGGASQE EFYKFIKPIL EKMDGTEELL
VKLNREDLLR KQRTFDNGSI PHQIHLGELH AILRRQEDFY
PFLKDNREKI EKILTFRIPY YVGPLARGNS RFAWMTRKSE
ETITPWNFEE VVDKGASAQS FIERMTNFDK NLPNEKVLPK
HSLLYEYFTV YNELTKVKYV TEGMRKPAFL SGEQKKAIVD
LLFKTNRKVT VKQLKEDYFK KIECFDSVEI SGVEDRFNAS
LGTYHDLLKI IKDKDFLDNE ENEDILEDIV LTLTLFEDRE
MIEERLKTYA HLFDDKVMKQ LKRRRYTGWG RLSRKLINGI
RDKQSGKTIL DFLKSDGFAN RNFMQLIHDD SLTFKEDIQK
AQVSGQGDSL HEHIANLAGS PAIKKGILQT VKVVDELVKV
MGRHKPENIV IEMARENQTT QKGQKNSRER MKRIEEGIKE
LGSQILKEHP VENTQLQNEK LYLYYLQNGR DMYVDQELDI
NRLSDYDVDH IVPQSFLKDD SIDNKVLTRS DKNRGKSDNV
PSEEVVKKMK NYWRQLLNAK LITQRKFDNL TKAERGGLSE
LDKAGFIKRQ LVETRQITKH VAQILDSRMN TKYDENDKLI
REVKVITLKS KLVSDFRKDF QFYKVREINN YHHAHDAYLN
AVVGTALIKK YPKLESEFVY GDYKVYDVRK MIAKSEQEIG
KATAKYFFYS NIMNFFKTEI TLANGEIRKR PLIETNGETG
EIVWDKGRDF ATVRKVLSMP QVNIVKKTEV QTGGFSKESI
LPKRNSDKLI ARKKDWDPKK YGGFDSPTVA YSVLVVAKVE
KGKSKKLKSV KELLGITIME RSSFEKNPID FLEAKGYKEV
KKDLIIKLPK YSLFELENGR KRMLASAGEL QKGNELALPS
KYVNFLYLAS HYEKLKGSPE DNEQKQLFVE QHKHYLDEII

-continued
EQISEFSKRV ILADANLDKV LSAYNKHRDK PIREQAENII

HLFTLTNLGA PAAFKYFDTT IDRKRYTSTK EVLDATLIHQ

SITGLYETRI DLSQLGGDSG GSPKKKRKV

Exemplary ABE:

(SEQ ID NO: 691)
MSEVEF SHEYWMRHAL TLAKRAWDER EVPVGAVLVH NNRVIGEGWN

RPIGRHDPTA HAEIMALRQG GLVMQNYRLI DATLYVTLEP

CVMCAGAMIH SRIGRVVFGA RDAKTGAAGS LMDVLHHPGM

NHRVEITEGI LADECAALLS DFFRMRRQEI KAQKKAQSST

DSGGSSGGSS GSETPGTSES ATPESSGGSS GGSSEVEFSH

EYWMRHALTL AKRARDEREV PVGAVLVLNN RVIGEGWNRA

IGLHDPTAHA EIMALRQGGL VMQNYRLIDA TLYVTFEPCV

MCAGAMIHSR IGRVVFGVRN AKTGAAGSLM DVLHYPGMNH

RVEITEGILA DECAALLCYF FRMPRQVFNA QKKAQSSTDS

GGSSGGSSGS ETPGTSESAT PESSGGSSGG SDKKYSIGLA

IGTNSVGWAV ITDEYKVPSK KFKVLGNTDR HSIKKNLIGA

LLFDSGETAE ATRLKRTARR RYTRRKNRIC YLQEIFSNEM

AKVDDSFFHR LEESFLVEED KKHERHPIFG NIVDEVAYHE

KYPTIYHLRK KLVDSTDKAD LRLIYLALAH MIKFRGHFLI

EGDLNPDNSD VDKLFIQLVQ TYNQLFEENP INASGVDAKA

ILSARLSKSR RLENLIAQLP GEKKNGLFGN LIALSLGLTP

NFKSNFDLAE DAKLQLSKDT YDDDLDNLLA QIGDQYADLF

LAAKNLSDAI LLSDILRVNT EITKAPLSAS MIKRYDEHHQ

DLTLLKALVR QQLPEKYKEI FFDQSKNGYA GYIDGGASQE

EFYKFIKPIL EKMDGTEELL VKLNREDLLR KQRTFDNGSI

-continued
PHQIHLGELH AILRRQEDFY PFLKDNREKI EKILTFRIPY

YVGPLARGNS RFAWMTRKSE ETITPWNFEE VVDKGASAQS

FIERMTNFDK NLPNEKVLPK HSLLYEYFTV YNELTKVKYV

TEGMRKPAFL SGEQKKAIVD LLFKTNRKVT VKQLKEDYFK

KIECFDSVEI SGVEDRFNAS LGTYHDLLKI IKDKDFLDNE

ENEDILEDIV LTLTLFEDRE MIEERLKTYA HLFDDKVMKQ

LKRRRYTGWG RLSRKLINGI RDKQSGKTIL DFLKSDGFAN

RNFMQLIHDD SLTFKEDIQK AQVSGQGDSL HEHIANLAGS

PAIKKGILQT VKVVDELVKV MGRHKPENIV IEMARENQTT

QKGQKNSRER MKRIEEGIKE LGSQILKEHP VENTQLQNEK

LYLYYLQNGR DMYVDQELDI NRLSDYDVDH IVPQSFLKDD

SIDNKVLTRS DKNRGKSDNV PSEEVVKKMK NYWRQLLNAK

LITQRKFDNL TKAERGGLSE LDKAGFIKRQ LVETRQITKH

VAQILDSRMN TKYDENDKLI REVKVITLKS KLVSDFRKDF

QFYKVREINN YHHAHDAYLN AVVGTALIKK YPKLESEFVY

GDYKVYDVRK MIAKSEQEIG KATAKYFFYS NIMNFFKTEI

TLANGEIRKR PLIETNGETG EIVWDKGRDF ATVRKVLSMP

QVNIVKKTEV QTGGFSKESI LPKRNSDKLI ARKKDWDPKK

YGGFDSPTVA YSVLVVAKVE KGKSKKLKSV KELLGITIME

RSSFEKNPID FLEAKGYKEV KKDLIIKLPK YSLFELENGR

KRMLASAGEL QKGNELALPS KYVNFLYLAS HYEKLKGSPE

DNEQKQLFVE QHKHYLDEII EQISEFSKRV ILADANLDKV

LSAYNKHRDK PIREQAENII HLFTLTNLGA PAAFKYFDTT

IDRKRYTSTK EVLDATLIHQ SITGLYETRI DLSQLGGDSG

GSPKKKRKV

ABEmax (SEQ ID NO: 210)
MKRTADGSEFESPKKKRKV_MSEVEFSHEYWMRHALTLAKRAWDEREVPVGAVLVH

NNRVIGEGWNRPIGRHDPTAHAEIMALRQGGLVMQNYRLIDATLYVTLEPCVMCAGAMIH

SRIGRVVFGARDAKTGAAGSLMDVLHHPGMNHRVEITEGILADECAALLSDFFRMRRQEI

KAQKKAQSSTD_ SGGSSGGSSGSETPGTSESATPESSGGSSGGS _SEVEFSHEYWMRHAL

TLAKRARDEREVPVGAVLVLNNRVIGEGWNRAIGLHDPTAHAEIMALRQGGLVMQNYRLI

DATLYVTFEPCVMCAGAMIHSRIGRVVFGVRNAKTGAAGSLMDVLHYPGMNHRVEITEGI

LADECAALLCYFFRMPRQVFNAQKKAQSSTD_ SGGSSGGSSGSETPGTSESATPESSGGS

SGGS _DKKYSIGLAIGTNSVGWAVITDEYKVPSKKFKVLGNTDRHSIKKNLIGALLFD

SGETAEATRLKRTARRRYTRRKNRICYLQEIFSNEMAKVDDSFFHRLEESFLVEEDK

KHERHPIFGNIVDEVAYHEKYPTIYHLRKKLVDSTDKADLRLIYLALAHMIKFRGHFL

IEGDLNPDNSDVDKLFIQLVQTYNQLFEENPINASGVDAKAILSARLSKSRRLENLIAQ

LPGEKKNGLFGNLIALSLGLTPNFKSNFDLAEDAKLQLSKDTYDDDLDNLLAQIGDQ

YADLFLAAKNLSDAILLSDILRVNTEITKAPLSASMIKRYDEHHQDLTLLKALVRQQL

-continued

PEKYKEIFFDQSKNGYAGYIDGGASQEEFYKFIKPILEKMDGTEELLVKLNREDLLRK

QRTFDNGSIPHQIHLGELHAILRRQEDFYPFLKDNREKIEKILTFRIPYYVGPLARGNS

RFAWMTRKSEETITPWNFEEVVDKGASAQSFIERMTNFDKNLPNEKVLPKHSLLYEY

FTVYNELTKVKYVTEGMRKPAFLSGEQKKAIVDLLFKTNRKVTVKQLKEDYFKKIE

CFDSVEISGVEDRFNASLGTYHDLLKIIKDKDFLDNEENEDILEDIVLTLTLFEDREMIE

ERLKTYAHLFDDKVMKQLKRRRYTGWGRLSRKLINGIRDKQSGKTILDFLKSDGFA

NRNFMQLIHDDSLTFKEDIQKAQVSGQGDSLHEHIANLAGSPAIKKGILQTVKVVDE

LVKVMGRHKPENIVIEMARENQTTQKGQKNSRERMKRIEEGIKELGSQILKEHPVEN

TQLQNEKLYLYYLQNGRDMYVDQELDINRLSDYDVDHIVPQSFLKDDSIDNKVLTR

SDKNRGKSDNVPSEEVVKKMKNYWRQLLNAKLITQRKFDNLTKAERGGLSELDKA

GFIKRQLVETRQITKHVAQILDSRMNTKYDENDKLIREVKVITLKSKLVSDFRKDFQF

YKVREINNYHHAHDAYLNAVVGTALIKKYPKLESEFVYGDYKVYDVRKMIAKSEQ

EIGKATAKYFFYSNIMNFFKTEITLANGEIRKRPLIETNGETGEIVWDKGRDFATVRK

VLSMPQVNIVKKTEVQTGGFSKESILPKRNSDKLIARKKDWDPKKYGGFDSPTVAYS

VLVVAKVEKGKSKKLKSVKELLGITIMERSSFEKNPIDFLEAKGYKEVKKDLIIKLPK

YSLFELENGRKRMLASAGELQKGNELALPSKYVNFLYLASHYEKLKGSPEDNEQKQ

LFVEQHKHYLDEIIEQISEFSKRVILADANLDKVLSAYNKHRDKPIREQAENIIHLFTLT

NLGAPAAFKYFDTTIDRKRYTSTKEVLDATLIHQSITGLYETRIDLSQLGGD KRTAD

GSEFEPKKKRKV[optional P2A-GFP]

Sequences 4. Codon Optimized Nucleotide Sequences of BE4, rAPOBEC, Ancestral APOBECs, ABE, and P2A GFP. Exemplary ABEmax:

(SEQ ID NO: 694)
MKRTADGSEFESPKKKRKVSEVEFSHEYWMRHALTLAKRAWDEREVPVGA

VLVHNNRVIGEGWNRPIGRHDPTAHAEIMALRQGGLVMQNYRLIDATLYVTLEPCV

MCAGAMIHSRIGRVVFGARDAKTGAAGSLMDVLHHPGMNHRVEITEGILADECAAL

LSDFFRMRRQEIKAQKKAQSSTDSGGSSGGSSGSETPGTSESATPESSGGSSGGSSEVE

FSHEYWMRHALTLAKRARDEREVPVGAVLVLNNRVIGEGWNRAIGLHDPTAHAEI

MALRQGGLVMQNYRLIDATLYVTFEPCVMCAGAMIHSRIGRVVFGVRNAKTGAAG

SLMDVLHYPGMNHRVEITEGILADECAALLCYFFRMPRQVFNAQKKAQSSTDSGGS

SGGSSGSETPGTSESATPESSGGSSGGSDKKYSIGLAIGTNSVGWAVITDEYKVPSKKF

KVLGNTDRHSIKKNLIGALLFDSGETAEATRLKRTARRRYTRRKNRICYLQEIFSNEM

AKVDDSFFHRLEESFLVEEDKKHERHPIFGNIVDEVAYHEKYPTIYHLRKKLVDSTDK

ADLRLIYLALAHMIKFRGHFLIEGDLNPDNSDVDKLFIQLVQTYNQLFEENPINASGV

DAKAILSARLSKSRRLENLIAQLPGEKKNGLFGNLIALSLGLTPNFKSNFDLAEDAKL

QLSKDTYDDDLDNLLAQIGDQYADLFLAAKNLSDAILLSDILRVNTEITKAPLSASMI

KRYDEHHQDLTLLKALVRQQLPEKYKEIFFDQSKNGYAGYIDGGASQEEFYKFIKPIL

EKMDGTEELLVKLNREDLLRKQRTFDNGSIPHQIHLGELHAILRRQEDFYPFLKDNRE

KIEKILTFRIPYYVGPLARGNSRFAWMTRKSEETITPWNFEEVVDKGASAQSFIERMT

NFDKNLPNEKVLPKHSLLYEYFTVYNELTKVKYVTEGMRKPAFLSGEQKKAIVDLLF

KTNRKVTVKQLKEDYFKKIECFDSVEISGVEDRFNASLGTYHDLLKIIKDKDFLDNEE

-continued

NEDILEDIVLTLTLFEDREMIEERLKTYAHLFDDKVMKQLKRRRYTGWGRLSRKLIN

GIRDKQSGKTILDFLKSDGFANRNFMQLIHDDSLTFKEDIQKAQVSGQGDSLHEHIAN

LAGSPAIKKGILQTVKVVDELVKVMGRHKPENIVIEMARENQTTQKGQKNSRERMK

RIEEGIKELGSQILKEHPVENTQLQNEKLYLYYLQNGRDMYVDQELDINRLSDYDVD

HIVPQSFLKDDSIDNKVLTRSDKNRGKSDNVPSEEVVKKMKNYWRQLLNAKLITQR

KFDNLTKAERGGLSELDKAGFIKRQLVETRQITKHVAQILDSRMNTKYDENDKLIRE

VKVITLKSKLVSDFRKDFQFYKVREINNYHHAHDAYLNAVVGTALIKKYPKLESEFV

YGDYKVYDVRKMIAKSEQEIGKATAKYFFYSNIMNFFKTEITLANGEIRKRPLIETNG

ETGEIVWDKGRDFATVRKVLSMPQVNIVKKTEVQTGGFSKESILPKRNSDKLIARKK

DWDPKKYGGFDSPTVAYSVLVVAKVEKGKSKKLKSVKELLGITIMERSSFEKNPIDF

LEAKGYKEVKKDLIIKLPKYSLFELENGRKRMLASAGELQKGNELALPSKYVNFLYL

ASHYEKLKGSPEDNEQKQLFVEQHKHYLDEIIEQISEFSKRVILADANLDKVLSAYNK

HRDKPIREQAENIIHLFTLTNLGAPAAFKYFDTTIDRKRYTSTKEVLDATLIHQSITGL

YETRIDLSQLGGDSGGSKRTADGSEFEPKKKRKV

Within base editor sequences, NLS sequences are bold, APOBEC and TadA sequences are italicized, linkers are double underlined, Cas9 nickase sequence is underlined, and UGI sequences are bold and italicized.
BE4 max and AncBE4 max (SEQ ID NO: 211)
ATGAAACGGACAGCCGACGGAAGCGAGTTCGAGTCACCAAAGAAGAAGCGG

AAAGTC *APOBEC* TCTGGAGGATCTAGCGGAGGATCCTCTGGCAGCGAGACACC

AGGAACAAGCGAGTCAGCAACACCAGAGAGCAGTGGCGGCAGCAGCGGCGGCA

GC GACAAGAAGTACAGCATCGGCCTGGACATCGGCACCAACTCTGTGGGCTGG

GCCGTGATCACCGACGAGTACAAGGTGCCCAGCAAGAAATTCAAGGTGCTGGGC

AACACCGACCGGCACAGCATCAAGAAGAACCTGATCGGAGCCCTGCTGTTCGAC

AGCGGCGAAACAGCCGAGGCCACCCGGCTGAAGAGAACCGCCAGAAGAAGATA

CACCAGACGGAAGAACCGGATCTGCTATCTGCAAGAGATCTTCAGCAACGAGAT

GGCCAAGGTGGACGACAGCTTCTTCCACAGACTGGAAGAGTCCTTCCTGGTGGA

AGAGGATAAGAAGCACGAGCGGCACCCCATCTTCGGCAACATCGTGGACGAGGT

GGCCTACCACGAGAAGTACCCCACCATCTACCACCTGAGAAAGAAACTGGTGGA

CAGCACCGACAAGGCCGACCTGCGGCTGATCTATCTGGCCCTGGCCCACATGATC

AAGTTCCGGGGCCACTTCCTGATCGAGGGCGACCTGAACCCCGACAACAGCGAC

GTGGACAAGCTGTTCATCCAGCTGGTGCAGACCTACAACCAGCTGTTCGAGGAA

AACCCCATCAACGCCAGCGGCGTGGACGCCAAGGCCATCCTGTCTGCCAGACTG

AGCAAGAGCAGACGGCTGGAAAATCTGATCGCCCAGCTGCCCGGCGAGAAGAA

GAATGGCCTGTTCGGAAACCTGATTGCCCTGAGCCTGGGCCTGACCCCCAACTTC

AAGAGCAACTTCGACCTGGCCGAGGATGCCAAACTGCAGCTGAGCAAGGACACC

TACGACGACGACCTGGACAACCTGCTGGCCCAGATCGGCGACCAGTACGCCGAC

CTGTTTCTGGCCGCCAAGAACCTGTCCGACGCCATCCTGCTGAGCGACATCCTGA

GAGTGAACACCGAGATCACCAAGGCCCCCCTGAGCGCCTCTATGATCAAGAGAT

-continued

```
ACGACGAGCACCACCAGGACCTGACCCTGCTGAAAGCTCTCGTGCGGCAGCAGC
TGCCTGAGAAGTACAAAGAGATTTTCTTCGACCAGAGCAAGAACGGCTACGCCG
GCTACATTGACGGCGGAGCCAGCCAGGAAGAGTTCTACAAGTTCATCAAGCCCA
TCCTGGAAAAGATGGACGGCACCGAGGAACTGCTCGTGAAGCTGAACAGAGAGG
ACCTGCTGCGGAAGCAGCGGACCTTCGACAACGGCAGCATCCCCCACCAGATCC
ACCTGGGAGAGCTGCACGCCATTCTGCGGCGGCAGGAAGATTTTTACCCATTCCT
GAAGGACAACCGGGAAAAGATCGAGAAGATCCTGACCTTCCGCATCCCCTACTA
CGTGGGCCCTCTGGCCAGGGGAAACAGCAGATTCGCCTGGATGACCAGAAAGAG
CGAGGAAACCATCACCCCCTGGAACTTCGAGGAAGTGGTGGACAAGGGCGCTTC
CGCCCAGAGCTTCATCGAGCGGATGACCAACTTCGATAAGAACCTGCCCAACGA
GAAGGTGCTGCCCAAGCACAGCCTGCTGTACGAGTACTTCACCGTGTATAACGA
GCTGACCAAAGTGAAATACGTGACCGAGGGAATGAGAAAGCCCGCCTTCCTGAG
CGGCGAGCAGAAAAAGGCCATCGTGGACCTGCTGTTCAAGACCAACCGGAAAGT
GACCGTGAAGCAGCTGAAAGAGGACTACTTCAAGAAAATCGAGTGCTTCGACTC
CGTGGAAATCTCCGGCGTGGAAGATCGGTTCAACGCCTCCCTGGGCACATACCA
CGATCTGCTGAAAATTATCAAGGACAAGGACTTCCTGGACAATGAGGAAAACGA
GGACATTCTGGAAGATATCGTGCTGACCCTGACACTGTTTGAGGACAGAGAGAT
GATCGAGGAACGGCTGAAAACCTATGCCCACCTGTTCGACGACAAAGTGATGAA
GCAGCTGAAGCGGCGGAGATACACCGGCTGGGGCAGGCTGAGCCGGAAGCTGAT
CAACGGCATCCGGGACAAGCAGTCCGGCAAGACAATCCTGGATTTCCTGAAGTC
CGACGGCTTCGCCAACAGAAACTTCATGCAGCTGATCCACGACGACAGCCTGAC
CTTTAAAGAGGACATCCAGAAAGCCCAGGTGTCCGGCCAGGGCGATAGCCTGCA
CGAGCACATTGCCAATCTGGCCGGCAGCCCCGCCATTAAGAAGGGCATCCTGCA
GACAGTGAAGGTGGTGGACGAGCTCGTGAAAGTGATGGGCCGGCACAAGCCCGA
GAACATCGTGATCGAAATGGCCAGAGAGAACCAGACCACCCAGAAGGGACAGA
AGAACAGCCGCGAGAGAATGAAGCGGATCGAAGAGGGCATCAAAGAGCTGGGC
AGCCAGATCCTGAAAGAACACCCCGTGGAAAACACCCAGCTGCAGAACGAGAA
GCTGTACCTGTACTACCTGCAGAATGGGCGGGATATGTACGTGGACCAGGAACT
GGACATCAACCGGCTGTCCGACTACGATGTGGACCATATCGTGCCTCAGAGCTTT
CTGAAGGACGACTCCATCGACAACAAGGTGCTGACCAGAAGCGACAAGAACCG
GGGCAAGAGCGACAACGTGCCCTCCGAAGAGGTCGTGAAGAAGATGAAGAACT
ACTGGCGGCAGCTGCTGAACGCCAAGCTGATTACCCAGAGAAAGTTCGACAATC
TGACCAAGGCCGAGAGAGGCGGCCTGAGCGAACTGGATAAGGCCGGCTTCATCA
AGAGACAGCTGGTGGAAACCCGGCAGATCACAAAGCACGTGGCACAGATCCTGG
ACTCCCGGATGAACACTAAGTACGACGAGAATGACAAGCTGATCCGGGAAGTGA
AAGTGATCACCCTGAAGTCCAAGCTGGTGTCCGATTTCCGGAAGGATTTCCAGTT
TTACAAAGTGCGCGAGATCAACAACTACCACCACGCCCACGACGCCTACCTGAA
CGCCGTCGTGGGAACCGCCCTGATCAAAAAGTACCCTAAGCTGGAAAGCGAGTT
CGTGTACGGCGACTACAAGGTGTACGACGTGCGGAAGATGATCGCCAAGAGCGA
GCAGGAAATCGGCAAGGCTACCGCCAAGTACTTCTTCTACAGCAACATCATGAA
CTTTTTTCAAGACCGAGATTACCCTGGCCAACGGCGAGATCCGGAAGCGGCCTCTG
```

ATCGAGACAAACGGCGAAACCGGGGAGATCGTGTGGGATAAGGGCCGGGATTTT

GCCACCGTGCGGAAAGTGCTGAGCATGCCCCAAGTGAATATCGTGAAAAAGACC

GAGGTGCAGACAGGCGGCTTCAGCAAAGAGTCTATCCTGCCCAAGAGGAACAGC

GATAAGCTGATCGCCAGAAAGAAGGACTGGGACCCTAAGAAGTACGGCGGCTTC

GACAGCCCCACCGTGGCCTATTCTGTGCTGGTGGTGGCCAAAGTGGAAAAGGGC

AAGTCCAAGAAACTGAAGAGTGTGAAAGAGCTGCTGGGGATCACCATCATGGAA

AGAAGCAGCTTCGAGAAGAATCCCATCGACTTTCTGGAAGCCAAGGGCTACAAA

GAAGTGAAAAAGGACCTGATCATCAAGCTGCCTAAGTACTCCCTGTTCGAGCTG

GAAAACGGCCGGAAGAGAATGCTGGCCTCTGCCGGCGAACTGCAGAAGGGAAA

CGAACTGGCCCTGCCCTCCAAATATGTGAACTTCCTGTACCTGGCCAGCCACTAT

GAGAAGCTGAAGGGCTCCCCCGAGGATAATGAGCAGAAACAGCTGTTTGTGGAA

CAGCACAAGCACTACCTGGACGAGATCATCGAGCAGATCAGCGAGTTCTCCAAG

AGAGTGATCCTGGCCGACGCTAATCTGGACAAAGTGCTGTCCGCCTACAACAAG

CACCGGGATAAGCCCATCAGAGAGCAGGCCGAGAATATCATCCACCTGTTTACC

CTGACCAATCTGGGAGCCCCTGCCGCCTTCAAGTACTTTGACACCACCATCGACC

GGAAGAGGTACACCAGCACCAAAGAGGTGCTGGACGCCACCCTGATCCACCAGA

GCATCACCGGCCTGTACGAGACACGGATCGACCTGTCTCAGCTGGGAGGTGAC A

GCGGCGGGAGCGGCGGGAGCGGGGGGAGC *ACTAATCTGAGCGACATCATTGAG*

*AAGGAGACTGGGAAACAGCTGGTCATTCAGGAGTCCATCCTGATGCTGCCTGAGG*

*AGGTGGAGGAAGTGATCGGCAACAAGCCAGAGTCTGACATCCTGGTGCACACCGC*

*CTACGACGAGTCCACAGATGAGAATGTGATGCTGCTGACCTCTGACGCCCCCGAGT*

*ATAAGCCTTGGGCCCTGGTCATCCAGGATTCTAACGGCGAGAATAAGATCAAGATG*

*CTG* AGCGGAGGATCCGGAGGATCTGGAGGCAGC *ACCAACCTGTCTGACATCAT*

*CGAGAAGGAGACAGGCAAGCAGCTGGTCATCCAGGAGAGCATCCTGATGCTGCCC*

*GAAGAAGTCGAAGAAGTGATCGGAAACAAGCCTGAGAGCGATATCCTGGTCCATA*

*CCGCCTACGACGAGAGTACCGACGAAAATGTGATGCTGCTGACATCCGACGCCCC*

*AGAGTATAAGCCCTGGGCTCTGGTCATCCAGGATTCCAACGGAGAGAACAAAATCA*

*AAATGCTG* TCTGGCGGCTCA AAAAGAACCGCCGACGGCAGCGAATTCGAGC

CCAAGAAGAAGAGGAAAGTC [optional P2A-GFP] TAA

The portion indicated by APOBEC in the above sequence of SEQ ID NO 211 may include any nucleic acid sequence encoding an APOBEC, or variant thereof, provided herein. For example, in some embodiments, the APOBEC may comprise any one of SEQ ID NOs: 37-42 or 212-217.
Rat APOBEC1

(SEQ ID NO: 212)
TCCTCAGAGACTGGGCCTGTCGCCGTCGATCCAACCCTGCGCCGCCGGAT

TGAACCTCACGAGTTTGAAGTGTTCTTTGACCCCCGGGAGCTGAGAAAGG

AGACATGCCTGCTGTACGAGATCAACTGGGGAGGCAGGCACTCCATCTGG

AGGCACACCTCTCAGAACACAAATAAGCACGTGGAGGTGAACTTCATCGA

GAAGTTTACCACAGAGCGGTACTTCTGCCCCAATACCAGATGTAGCATCA

CATGGTTTCTGAGCTGGTCCCCTTGCGGAGAGTGTAGCAGGGCCATCACC

GAGTTCCTGTCCAGATATCCACACGTGACACTGTTTATCTACATCGCCAG

GCTGTATCACCACGCAGACCCAAGGAATAGGCAGGGCCTGCGCGATCTGA

TCAGCTCCGGCGTGACCATCCAGATCATGACAGAGCAGGAGTCCGGCTAC

TGCTGGCGGAACTTCGTGAATTATTCTCCTAGCAACGAGGCCCACTGGCC

TAGGTACCCACACCTGTGGGTGCGCCTGTACGTGCTGGAGCTGTATTGCA

TCATCCTGGGCCTGCCCCCTTGTCTGAATATCCTGCGGAGAAAGCAGCCC

CAGCTGACCTTCTTTACAATCGCCCTGCAGTCTTGTCACTATCAGAGGCT

GCCACCCCACATCCTGTGGGCCACAGGCCTGAAG

Anc689 APOBEC (SEQ ID NO: 213)
AGCAGTGAAACCGGACCAGTGGCAGTGGACCCAACCCTGAGGAGACGGAT
TGAGCCCCATGAATTTGAAGTGTTCTTTGACCCAAGGGAGCTGAGGAAGG
AGACATGCCTGCTGTACGAGATCAAGTGGGGCACAAGCCACAAGATCTGG
CGCCACAGCTCCAAGAACACCACAAAGCACGTGGAAGTGAATTTCATCGA
GAAGTTTACCTCCGAGCGGCACTTCTGCCCCTCTACCAGCTGTTCCATCA
CATGGTTTCTGTCTTGGAGCCCTTGCGGCGAGTGTTCCAAGGCCATCACC
GAGTTCCTGTCTCAGCACCCTAACGTGACCCTGGTCATCTACGTGGCCCG
GCTGTATCACCACATGGACCAGCAGAACAGGCAGGGCCTGCGCGATCTGG
TGAATTCTGGCGTGACCATCCAGATCATGACAGCCCCAGAGTACGACTAT
TGCTGGCGGAACTTCGTGAATTATCCACCTGGCAAGGAGGCACACTGGCC
AAGATACCCACCCCTGTGGATGAAGCTGTATGCACTGGAGCTGCACGCAG
GAATCCTGGGCCTGCCTCCATGTCTGAATATCCTGCGGAGAAAGCAGCCC
CAGCTGACATTTTTCACCATTGCTCTGCAGTCTTGTCACTATCAGCGGCT
GCCTCCTCATATTCTGTGGGCTACAGGCCTTTGAAA

Anc687 APOBEC (SEQ ID NO: 214)
TCATCAGAAACAGGACCAGTCGCCGTGGACCCAACACTGAGGAGAAGGAT
TGAGCCCCATGAATTTGAAGTCTTTTTCGACCCCAGGGAGCTGAGGAAGG
AGGCATGCCTGCTGTACGAGATCAAGTGGGGCACAAGCCACAAGATCTGG
CGCAACAGCGGCAAGAACACCACAAAGCACGTGGAAGTGAATTTCATCGA
GAAGTTTACCTCCGAGCGGCACTTCTGCCCCTCTATCAGCTGTTCCATCA
CATGGTTTCTGTCTTGGAGCCCTTGCTGGGAGTGTTCCAAGGCCATCCGC
GAGTTCCTGTCTCAGCACCCTAACGTGACCCTGGTCATCTACGTGGCCCG
GCTGTTTCAACACATGGACCAGCAGAACAGGCAGGGCCTGCGCGATCTGG
TGAATTCTGGCGTGACCATCCAGATCATGACAGCCTCAGAGTACGACCAT
TGCTGGCGGAACTTCGTGAATTATCCACCTGGCAAGGAGGCACACTGGCC
AAGATACCCACCCCTGTGGATGAAGCTGTATGCACTGGAGCTGCACGCAG
GAATCCTGGGCCTGCCTCCATGTCTGAATATCCTGCGGAGAAAGCAGCCC
CAGCTGACATTTTTCACTATCGCACTGCAGAGCTGTCATTACCAGAGACT
GCCTCCTCATATCCTGTGGGCTACAGGCCTTTGAAA

Anc686 APOBEC (SEQ ID NO: 215)
AGCAGCGAGACAGGACCCGTGGCAGTGGACCCTACACTGAGGAGGAGGAT
TGAGCCCGAATTTTTCAACAGGAACTACGACCCCAGAGAGCTGCGGAAGG
AGACATACCTGCTGTATGAGATCAAGTGGGGCAAGGAGTCCAAGATCTGG
CGGCACACCTCTAACAATAGAACACAGCACGCCGAGGTGAACTTCCTGGA
GAACTTCTTTAATGAGCTGTACTTTAATCCTTCTACCCACTGCAGCATCA
CATGGTTCCTGAGCTGGTCCCCATGCGGCGAGTGTTCTAAGGCCATCGTG
GAGTTTCTGAAGGAGCACCCCAACGTGAATCTGGAGATCTACGTGGCCAG
GCTGTATCTGTGCGAGGACGAGAGGAACAGGCAGGGCCTGCGGGATCTGG
TGAATAGCGGCGTGACCATCAGAATCATGAACCTGCCTGACTACAATTAT
TGTTGGCGCACATTCGTGTCCCACCAGGGAGGCGACGAGGATTATTGGCC
AAGGCACTTTGCACCATGGGTGCGCCTGTACGTGCTGGAGCTGTATTGCA
TCATCCTGGGCCTGCCCCCTTGTCTGAACATCCTGCGGAGAAAGCAGCCC
CAGCTGACATTCTTCACCATCGCACTGCAGAGTTGTCATTACCAGCGACT
GCCTCCTCATATCCTGTGGGCTACAGGCCTTTGAAA

Anc655 APOBEC (SEQ ID NO: 216)
TCATCAGAGACCGGACCTGTGGCAGTGGACCCAACCCTGCGACGGAGAAT
CGAGCCCTTTTACTTTCAGTTCAACAACGACCCAAGGAGCCTGCCGGAGAA
AGACCTACCTGTGCTATGAGCTGAAGCAGGACGGCTCTACCTGGGTGTGG
AAGCGGACACTGCACAACAAGGGCAGACACGCCGAGATCTGCTTCCTGGA
GAAGATCAGCTCCCTGGAGAAGCTGGACCCTGCCCAGCACTACAGGATCA
CATGGTATATGTCTTGGAGCCCATGCTCCAACTGTGCCCAGAAGATCGTG
GATTTTCTGAAGGAGCACCCACACGTGAATCTGCGGATCTACGTGGCCAG
ACTGTACTATCACGAGGAGGAGAGGTATCAGGAGGGCCTGAGGAACCTGA
GGCGCTCCGGCGTGTCTATCAGAGTGATGGACCTGCCCGATTTCGAGCAC
TGCTGGGAGACATTCGTGGATAACGGAGGAGGACCTTTCCAGCCATGGCC
CGGCCTGGAGGAGCTGAATAGCAAGCAGCTGTCCCGGAGACTGCAGGCAG
GAATCCTGGGCCTGCCCCCTTGTCTGAATATCCTGAGGCGCAAGCAGCCC
CAGCTGACATTTTTCACCATCGCACTGCAGAGTTGTCATTATCAGCGACT
GCCTCCTCATATCCTGTGGGCTACAGGCCTTTGAAA

Anc733 APOBEC (SEQ ID NO: 217)
AGCAGCGAGACCGGACCTGTGGCAGTGGACCCAACCCTGAGAAGACGCAT
TGAGCCATTTCATTTTCAGTTTAACAACGACCCCAGAGCCTACCGGAGAA
AGACCTACCTGTGCTATGAGCTGAAGCAGGACGGCTCCACCTGGGTGCTG
GATCGGACACTGAGAAACAAGGGCCGGCACGCCGAGATCTGTTTCCTGGA
CAAGATCAATTCCTGGGAGAGGCTGGATCCCGCCCAGCACTACCGCGTGA
CATGGTATATGAGCTGGTCCCTTGCTCTAACTGTGCCCAGCAGGTGGTG
GATTTCCTGAAGGAGCACCCACACGTGAATCTGCGGATCTTTGCCGCCAG
ACTGTACTATCACGAGCAGAGGCGCTATCAGGAGGGCCTGCGGAGCCTGA
GGGGAAGCGGAGTGCCTGTGGCCGTGATGACCCTGCCAGACTTCGAGCAC
TGCTGGGAGACATTTGTGGATCACGGCGGCCGGCCATTCCAGCCATGGGA
CGGCCTGGAGGAGCTGAACTCTAGGAGCCTGTCCCGGAGACTGCAGGCAG
GAATCCTGGGCCTGCCCCCTTGTCTGAATATCCTGAGGCGCAAGCAGCCC
CAGCTGACCTTTTTTACCATCGCACTGCAGAGTTGTCACTACCAGAGACT
GCCTCCTCATATCCTGTGGGCTACAGGCCTTTGAAA

P2A-GFP (SEQ ID NO: 218)
TCTGGTGGTTCTCCCAAGAAGAAGAGGAAAGTCGGAAGCGGAGCTACTAA
CTTCAGCCTGCTGAAGCAGGCTGGAGACGTGGAGGAGAACCCTGGACCTA
TGGTGAGCAAGGGCGAGGAGCTGTTCACCGGGGTGGTGCCCATCCTGGTC
GAGCTGGACGGCGACGTAAACGGCCACAAGTTCAGCGTGTCCGGCGAGGG
CGAGGGCGATGCCACCTACGGCAAGCTGACCCTGAAGTTCATCTGCACCA
CCGGCAAGCTGCCCGTGCCCTGGCCCACCCTCGTGACCACCCTGACCTAC
GGCGTGCAGTGCTTCAGCCGCTACCCCGACCACATGAAGCAGCACGACTT
CTTCAAGTCCGCCATGCCCGAAGGCTACGTCCAGGAGCGCACCATCTTCT
TCAAGGACGACGGCAACTACAAGACCCGCGCCGAGGTGAAGTTCGAGGGC
GACACCCTGGTGAACCGCATCGAGCTGAAGGGCATCGACTTCAAGGAGGA
CGGCAACATCCTGGGGCACAAGCTGGAGTACAACTACAACAGCCACAACG
TCTATATCATGGCCGACAAGCAGAAGAACGGCATCAAGGTGAACTTCAAG
ATCCGCCACAACATCGAGGACGGCAGCGTGCAGCTCGCCGACCACTACCA
GCAGAACACCCCCATCGGCGACGGCCCCGTGCTGCTGCCCGACAACCACT
ACCTGAGCACCCAGTCCGCCCTGAGCAAAGACCCCAACGAGAAGCGCGAT
CACATGGTCCTGCTGGAGTTCGTGACCGCCGCCGGGATCACTCTCGGCAT
GGACGAGCTGTACAAGTCTGGTGGTTCTCCCAAGAAGAAGAGGAAAGTCT
AA

ABEmax (SEQ ID NO: 219)
ATGAAACGGACAGCCGACGGAAGCGAGTTCGAGTCACCAAAGA

AGAAGCGGAAAGTC *TCTGAAGTCGAGTTTAGCCACGAGTATTGGATGAGGCACGC*
*ACTGACCCTGGCAAAGCGAGCATGGGATGAAAGAGAAGTCCCCGTGGGCGCCGTGCT*
*GGTGCACAACAATAGAGTGATCGGAGAGGGATGGAACAGGCCAATCGGCCGCCACGA*
*CCCTACCGCACACGCAGAGATCATGGCACTGAGGCAGGGAGGCCTGGTCATGCAGAA*
*TTACCGCCTGATCGATGCCACCCTGTATGTGACACTGGAGCCATGCGTGATGTGCGCA*
*GGAGCAATGATCCACAGCAGGATCGGAAGAGTGGTGTTCGGAGCACGGGACGCCAAG*
*ACCGGCGCAGCAGGCTCCCTGATGGATGTGCTGCACCACCCCGGCATGAACCACCGG*
*GTGGAGATCACAGAGGGAATCCTGGCAGACGAGTGCGCCGCCCTGCTGAGCGATTTC*
*TTTAGAATGCGGAGACAGGAGATCAAGGCCCAGAAGAAGGCACAGAGCTCCACCGAC*
<u>*TCTGGAGGATCTAGCGGAGGATCCTCTGGAAGCGAGACACCAGGCACAAGCGA*</u>
<u>*GTCCGCCACACCAGAGAGCTCCGGCGGCTCCTCCGGAGGATCC*</u> *TCTGAGGTGGA*
*GTTTTCCCACGAGTACTGGATGAGACATGCCCTGACCCTGGCCAAGAGGGCACGCGA*
*TGAGAGGGAGGTGCCTGTGGGAGCCGTGCTGGTGCTGAACAATAGAGTGATCGGCGA*
*GGGCTGGAACAGAGCCATCGGCCTGCACGACCCAACAGCCCATGCCGAAATTATGGC*
*CCTGAGACAGGGCGGCCTGGTCATGCAGAACTACAGACTGATTGACGCCACCCTGTA*
*CGTGACATTCGAGCCTTGCGTGATGTGCGCCGGCGCCATGATCCACTCTAGGATCGG*
*CCGCGTGGTGTTTGGCGTGAGGAACGCAAAAACCGGCGCCGCAGGCTCCCTGATGGA*
*CGTGCTGCACTACCCCGGCATGAATCACCGCGTCGAAATTACCGAGGGAATCCTGGC*
*AGATGAATGTGCCGCCCTGCTGTGCTATTTCTTTCGGATGCCTAGACAGGTGTTCAATG*
*CTCAGAAGAAGGCCCAGAGCTCCACCGAC* <u>*TCCGGAGGATCTAGCGGAGGCTCCTC*</u>
<u>*TGGCTCTGAGACACCTGGCACAAGCGAGAGCGCAACACCTGAAAGCAGCGGGG*</u>
<u>*GCAGCAGCGGGGGGTCA*</u> *GACAAGAAGTACAGCATCGGCCTGGCCATCGGCACC*
<u>*AACTCTGTGGGCTGGGCCGTGATCACCGACGAGTACAAGGTGCCCAGCAAGAAA*</u>
<u>*TTCAAGGTGCTGGGCAACACCGACCGGCACAGCATCAAGAAGAACCTGATCGGA*</u>
<u>*GCCCTGCTGTTCGACAGCGGCGAAACAGCCGAGGCCACCCGGCTGAAGAGAACC*</u>
<u>*GCCAGAAGAAGATACACCAGACGGAAGAACCGGATCTGCTATCTGCAAGAGATC*</u>
<u>*TTCAGCAACGAGATGGCCAAGGTGGACGACAGCTTCTTCCACAGACTGGAAGAG*</u>
<u>*TCCTTCCTGGTGGAAGAGGATAAGAAGCACGAGCGGCACCCCATCTTCGGCAAC*</u>

```
ATCGTGGACGAGGTGGCCTACCACGAGAAGTACCCCACCATCTACCACCTGAGA
AAGAAACTGGTGGACAGCACCGACAAGGCCGACCTGCGGCTGATCTATCTGGCC
CTGGCCCACATGATCAAGTTCCGGGGCCACTTCCTGATCGAGGGCGACCTGAACC
CCGACAACAGCGACGTGGACAAGCTGTTCATCCAGCTGGTGCAGACCTACAACC
AGCTGTTCGAGGAAAACCCCATCAACGCCAGCGGCGTGGACGCCAAGGCCATCC
TGTCTGCCAGACTGAGCAAGAGCAGACGGCTGGAAAATCTGATCGCCCAGCTGC
CCGGCGAGAAGAAGAATGGCCTGTTCGGAAACCTGATTGCCCTGAGCCTGGGCC
TGACCCCCAACTTCAAGAGCAACTTCGACCTGGCCGAGGATGCCAAACTGCAGC
TGAGCAAGGACACCTACGACGACGACCTGGACAACCTGCTGGCCCAGATCGGCG
ACCAGTACGCCGACCTGTTTCTGGCCGCCAAGAACCTGTCCGACGCCATCCTGCT
GAGCGACATCCTGAGAGTGAACACCGAGATCACCAAGGCCCCCCTGAGCGCCTC
TATGATCAAGAGATACGACGAGCACCACCAGGACCTGACCCTGCTGAAAGCTCT
CGTGCGGCAGCAGCTGCCTGAGAAGTACAAAGAGATTTTCTTCGACCAGAGCAA
GAACGGCTACGCCGGCTACATTGACGGCGGAGCCAGCCAGGAAGAGTTCTACAA
GTTCATCAAGCCCATCCTGGAAAAGATGGACGGCACCGAGGAACTGCTCGTGAA
GCTGAACAGAGAGGACCTGCTGCGGAAGCAGCGGACCTTCGACAACGGCAGCAT
CCCCCACCAGATCCACCTGGGAGAGCTGCACGCCATTCTGCGGCGGCAGGAAGA
TTTTTACCCATTCCTGAAGGACAACCGGGAAAAGATCGAGAAGATCCTGACCTTC
CGCATCCCCTACTACGTGGGCCCTCTGGCCAGGGGAAACAGCAGATTCGCCTGG
ATGACCAGAAAGAGCGAGGAAACCATCACCCCCTGGAACTTCGAGGAAGTGGTG
GACAAGGGCGCTTCCGCCCAGAGCTTCATCGAGCGGATGACCAACTTCGATAAG
AACCTGCCCAACGAGAAGGTGCTGCCCAAGCACAGCCTGCTGTACGAGTACTTC
ACCGTGTATAACGAGCTGACCAAAGTGAAATACGTGACCGAGGGAATGAGAAAG
CCCGCCTTCCTGAGCGGCGAGCAGAAAAAGGCCATCGTGGACCTGCTGTTCAAG
ACCAACCGGAAAGTGACCGTGAAGCAGCTGAAAGAGGACTACTTCAAGAAAATC
GAGTGCTTCGACTCCGTGGAAATCTCCGGCGTGGAAGATCGGTTCAACGCCTCCC
TGGGCACATACCACGATCTGCTGAAAATTATCAAGGACAAGGACTTCCTGGACA
ATGAGGAAAACGAGGACATTCTGGAAGATATCGTGCTGACCCTGACACTGTTTG
AGGACAGAGAGATGATCGAGGAACGGCTGAAAACCTATGCCCACCTGTTCGACG
ACAAAGTGATGAAGCAGCTGAAGCGGCGGAGATACACCGGCTGGGGCAGGCTG
AGCCGGAAGCTGATCAACGGCATCCGGGACAAGCAGTCCGGCAAGACAATCCTG
GATTTCCTGAAGTCCGACGGCTTCGCCAACAGAAACTTCATGCAGCTGATCCACG
ACGACAGCCTGACCTTTAAAGAGGACATCCAGAAAGCCCAGGTGTCCGGCCAGG
GCGATAGCCTGCACGAGCACATTGCCAATCTGGCCGGCAGCCCCGCCATTAAGA
AGGGCATCCTGCAGACAGTGAAGGTGGTGGACGAGCTCGTGAAAGTGATGGGCC
GGCACAAGCCCGAGAACATCGTGATCGAAATGGCCAGAGAGAACCAGACCACC
CAGAAGGGACAGAAGAACAGCCGCGAGAGAATGAAGCGGATCGAAGAGGGCAT
CAAAGAGCTGGGCAGCCAGATCCTGAAAGAACACCCCGTGGAAAACACCCAGCT
GCAGAACGAGAAGCTGTACCTGTACTACCTGCAGAATGGGCGGGATATGTACGT
GGACCAGGAACTGGACATCAACCGGCTGTCCGACTACGATGTGGACCATATCGT
```

-continued

GCCTCAGAGCTTTCTGAAGGACGACTCCATCGACAACAAGGTGCTGACCAGAAG

CGACAAGAACCGGGGCAAGAGCGACAACGTGCCCTCCGAAGAGGTCGTGAAGA

AGATGAAGAACTACTGGCGGCAGCTGCTGAACGCCAAGCTGATTACCCAGAGAA

AGTTCGACAATCTGACCAAGGCCGAGAGAGGCGGCCTGAGCGAACTGGATAAGG

CCGGCTTCATCAAGAGACAGCTGGTGGAAACCCGGCAGATCACAAAGCACGTGG

CACAGATCCTGGACTCCCGGATGAACACTAAGTACGACGAGAATGACAAGCTGA

TCCGGGAAGTGAAAGTGATCACCCTGAAGTCCAAGCTGGTGTCCGATTTCCGGA

AGGATTTCCAGTTTTACAAAGTGCGCGAGATCAACAACTACCACCACGCCCACG

ACGCCTACCTGAACGCCGTCGTGGGAACCGCCCTGATCAAAAAGTACCCTAAGC

TGGAAAGCGAGTTCGTGTACGGCGACTACAAGGTGTACGACGTGCGGAAGATGA

TCGCCAAGAGCGAGCAGGAAATCGGCAAGGCTACCGCCAAGTACTTCTTCTACA

GCAACATCATGAACTTTTTCAAGACCGAGATTACCCTGGCCAACGGCGAGATCCG

GAAGCGGCCTCTGATCGAGACAAACGGCGAAACCGGGGAGATCGTGTGGGATAA

GGGCCGGGATTTTGCCACCGTGCGGAAAGTGCTGAGCATGCCCCAAGTGAATAT

CGTGAAAAAGACCGAGGTGCAGACAGGCGGCTTCAGCAAAGAGTCTATCCTGCC

CAAGAGGAACAGCGATAAGCTGATCGCCAGAAAGAAGGACTGGGACCCTAAGA

AGTACGGCGGCTTCGACAGCCCCACCGTGGCCTATTCTGTGCTGGTGGTGGCCAA

AGTGGAAAAGGGCAAGTCCAAGAAACTGAAGAGTGTGAAAGAGCTGCTGGGGA

TCACCATCATGGAAAGAAGCAGCTTCGAGAAGAATCCCATCGACTTTCTGGAAG

CCAAGGGCTACAAAGAAGTGAAAAAGGACCTGATCATCAAGCTGCCTAAGTACT

CCCTGTTCGAGCTGGAAAACGGCCGGAAGAGAATGCTGGCCTCTGCCGGCGAAC

TGCAGAAGGGAAACGAACTGGCCCTGCCCTCCAAATATGTGAACTTCCTGTACCT

GGCCAGCCACTATGAGAAGCTGAAGGGCTCCCCCGAGGATAATGAGCAGAAACA

GCTGTTTGTGGAACAGCACAAGCACTACCTGGACGAGATCATCGAGCAGATCAG

CGAGTTCTCCAAGAGAGTGATCCTGGCCGACGCTAATCTGGACAAAGTGCTGTCC

GCCTACAACAAGCACCGGGATAAGCCCATCAGAGAGCAGGCCGAGAATATCATC

CACCTGTTTACCCTGACCAATCTGGGAGCCCCTGCCGCCTTCAAGTACTTTGACA

CCACCATCGACCGGAAGAGGTACACCAGCACCAAAGAGGTGCTGGACGCCACCC

TGATCCACCAGAGCATCACCGGCCTGTACGAGACACGGATCGACCTGTCTCAGCT

GGGAGGTGAC_TCTGGCGGCTCA AAAAGAACCGCCGACGGCAGCGAATTCGA

GCCCAAGAAGAAGAGGAAAGTC_[optionalP2A-GFP]_TAA

Sequences 5. APOBEC Homologs Used for Ancestral Reconstruction.

(SEQ ID NO: 220)
LGKEFCGAFYHPRSKSKQSCAIAKRGHDATLTRRYTNSKKHAEEFFLMDIDCQARHF
WNKKWQITMYLTMQPCHSTDTGGTKEDQSCCEVMIKAKEKLGNVEIVIKPTHLCQV
GKGKPEKGVRKLKTTGIELECMKEGDWKYYAQPEENPYDTSKTEELHNQQLEQ

>D8M4Y9_BLAHO/46-382

(SEQ ID NO: 221)
CMATGTKCVGAKAQSPEGFVVNDCHAEVLCRRSFIHYLIKEIQKVFEPCEGDFHLQV
KRDYHFYMYISQSPCGYGSEYETNGKAMEQSCSDKLCLLISPIYLTGIVICWDEARM
KNALADRIEVSAIVWSFFKEVVQYKEIKRERYEQAKESLMK

>I1F5T9_AMPQE/52-472

-continued (SEQ ID NO: 222)
SLGTGSKCIGEHKMSLEGWLVNDSHAEIIARRGFVKYLIGQLKSIFERSPIKGQYSIKN
GGDASIFLSTKHSSCSDKMMRLIDKPVYLHSITVELYNQEAMERALVGRLCLSKELL
GSIVWSDFKELVQNDLPVYYDWKQSSYQKARTLFN

>E9GMF4_DAPPU/61-428

(SEQ ID NO: 223)
SMGTGSKCVGQNKLSKDGDILNDSHAEVVARRGFLRYMYHQMEILFTVDAISKKFL
QREGVSFIFFSSHTPCGDASIIVKENSMCNSCSDKLAKFLSKPIYVSHVIICPYSQSVME
RALINRFEHSANQLSSISWQKFVSLLSDNLPIYNKAKRLCYFEMWEQTRA

>K7J168_NASVI/49-389

(SEQ ID NO: 224)
SLCTGTKCLSGVELRSTGNKLSDSHAEILARRAFLRYLHQIELIFYLEDNGIKLRDVS
FHFFSSQTPCGDCSIIKLTGEDLSCSDKLAKLMIPTIKFESIVICPYSLESMQRGIFQRFD
PSSIVWKTFLTIYDPQHPKYYHCKQYSYQNLWREKS

>F4X2X4_ACREC/49-389

(SEQ ID NO: 225)
ALATGTKCLGDSELSKGGSRLSDSHAEVLTRRAFIRYLYDQIDLIFSRNDKNKIELNS
NISFHFFSSQTPCGDCSIFKLETNSCSDKIAKLLIPPIKLESITISPFSLDAMERGLYKREN
NISIIWQSFLQIFDIRHPKYYDWKQWSYQNEWKQLKH

>E9IK04_SOLIN/50-395

(SEQ ID NO: 226)
ALATGTKCLGDSELSESGSRLSDSHAEVLTRRAFIRYLYDQIDLIFSRNDDNEIELNNN
ISFHFFSSQTPCGDCSIFKEETTSDSCSDKMAKLMIPPIKLESITICPFSLDAMERGLYKR
FNNISIVWRSFLQIFDIRHPKYYDWKQWSYQNEWKRLRR

>E2AUE8_CAMFO/49-391

(SEQ ID NO: 227)
ALATGTKCLGESELINDGSRLSDSHAEVLARRAFIRYLYDQIDLVFSWSHKNKIELNS
NVSFHFFSSQTPCGDCSIFKHEIYSCSDKMAKLLIPPIKLKSITICPFSLDAMERGLYKR
FNNTSIIWQTFLQIFDIRHPKYYDWKQWSYQSKWKQLKL

>E2B4R0_HARSA/49-389

(SEQ ID NO: 228)
ALATGTKCLGESELTNSGSRLSDSHAEVLTRRAFIRYLYDQIDLVFKRNDKNKIELNS
AISFHFFSSQTPCGDCSIFKEKTSNSCSDKIAKLMIPSIRLESITICPFSFDAMERGLYKR
FNNSSIIWQTFLQVLDIKHPKYYDWKQWSYQNKWRQLQF

>B0WPX1_CULQU/53-394

(SEQ ID NO: 229)
SLGTGTKCLGADQLSEKGDILNDSHAEVMARRGFLRFVMQQMTSIFEFNSESRKFSC
KSGISFHFFTTHSPCGDASIYETSRSSCSDKMARLLERPIYLESVVITDFCKEAIERALW
KRWDPDVVEGGGIVWATFAAVWKGADMDYVDVKNRSYREQWDALRV

>B4NPW3_DROWI/50-393

(SEQ ID NO: 230)
SLGCGTKCIGQDKQCPKGYILNDSHAEIIARRAFLRYLYHELNKIFEWDHELVCYKLK
KHYEYHFLCTHTPCGDACIGQLDTEVSCSDKLARLIHEPIYFTSFNFSEANVADIERAI
FKRWQHKEFRNGLSWLCFLELLRIRKSLYGTCKQLAYQEAWQQLKS

>B4JCX0_DROGR/56-405

(SEQ ID NO: 231)
SLATGTRCIGSSKLCARGFILNDCHAEVLARRGFLRYLNNEIMKIFSWQTAERCFTLN
ENLVFHFLSTQTPCGDACILESNIDTLSCSDKLSRLLNKPIYFTSFNFADAHLKSLQRA
LYQRWNGRSCKNSLIWLNFLNLLLNRQKLYAQCKALAYQLVWQQLKC

>B4M8L0_DROVI/67-417

(SEQ ID NO: 232)
ALATGTRCIGASKLCAKGFVINDSHAEVLARRAFLRYLHNQLLKIFSWKSAAGCFTL
NEQLEYHELSTQTPCGDACIVDSEILSCSDKLSRLIDKPIYESSLNFAEARLESLQRAV
YQRWRGRNCSTSLIWLNFLDLLHLREKFYAECKALAYQLAWRQLKC

>B4KIX6_DROMO/54-403

(SEQ ID NO: 233)
ALATGTRCIGASKLCNRGYILNDCHAEVLARRAFLRYLQNELLNVFIWKPSTGCFAL
NEQLEYHELSTQTPCGDACIVDDACGVSCSDKLARVIDKPIYFISYNFTEANPESLERA
IYRRWQGRECNSSLIWINFMDLLSVREKLYSELKALSYQLAWQQLKS

>Q29K71_DROPS/55-392

(SEQ ID NO: 234)
ALGCGTKCIGYTRHCPKGFILNDSHAEVLARRAFLRYLHELEHIFQWAAKRGSFDL
SAHVEYHFFSTQTPCGDACIVESVVVESCSDKLARLLSKPIYFSTLNFTEARQESVER
AIYKRWQQGRDSKNGLVWLKFLNILHLREKFYASCKDLCYQQAWCQLKR

>B3MN31_DROAN/55-389

(SEQ ID NO: 235)
ALGLGTKCIPHTKLCENGFILNDSHAEVLARRAFQRYLYHELGQIFHWNCDSQCYDL
DDHVEYHELSTQTPCGDACIVEEDRSCSDKLSRLISKPIYFSTLNFADAHFESLNRAIY
KRWEGRNFSNGLVWLTFLDCISLSEKFYATCKSWSYQEAWLQLKD

>B4HX96_DROSE/54-382
(SEQ ID NO: 236)
SLGCGTKCIGESKLCPKGLILNDSHAEVLARRGFLRFLYQELKQIFHWNSELSTFDMD
EHVEFHELSTQTPCGDACILEEQVSCSDKIARLISKPIYFSSLNFDDAQLESLERAIFKR
FECRSFKNGLIWLTFLELVKLSEKFYASCKNLAYQFAWREIKE

>H2YAA2_CIOSA/58-486
(SEQ ID NO: 237)
AIGSGTTCLGESQMRPDGLILHDSHAEVIARRSFIRYLYHEIKSIFNKLIDGKCCLKPGI
SFHFYTSNTPCGDATIFVTVNQPVNTSCSDKILRLVSTPVYMRSIVVADIQALRRAFY
GRMDLNSLDFSALSWRMFKEVMECELKSYRNCKLLAYFNTWSDVKD

>C3Y8L3_BRAFL/55-488
(SEQ ID NO: 238)
AMGTGSKCIGRSKMRLEGDVLHDSHAEIIARRAFLRYLYHQLMVFTTPGADCRCG
LKPGVKFHLFTSHTPCGDASIFKGSKSTIDQSCSDKLARFMTEPVYFSTIVVCPYSSYA
MYRGIVDRCAGIQDLAAIMWETFKQLLNERRPAYGDYKRAAHHTAKTCFLR

>F1R076_DANRE/54-459
(SEQ ID NO: 239)
SLGTGTKCIGRSAMSMKGDVLNDSHAEVIARRGSVRYLTEQLLKVFCAGSEKGKWR
LKAGVSFLFFTSQTPCGDASIFMSGSEPCETSCSDKLARYLQEALYFSAVLVSPYSHP
ALRRALHTRCSHVKDLAAISWHSFLKVVAAELPEYWDYKQAAYQLAWTQLRL

>H2S4J7_TAKRU/61-472
(SEQ ID NO: 240)
SLATGTKCIGRTALSPNGDVLNDSHAEVIARRGCVRYLIQELHRVFCRAEQQGKWKL
KPGVSFHFFTSHTPCGDASIIMSDSQPCPGSCSDKMARYLQEALYFTSVVVCPYSQEV
MHRALVARCLHVSDLAAISWHSFLSLVSSSLPSYWDYKRASYQQAWQQLHS

>ADAT1_XENTR/59-465
(SEQ ID NO: 241)
AMGTGTKCIGQAKLRKTGDVLQDSHAEIIAKRSFQRYLLHQLSLLFIPGTEKGKWML
RPEISFVFFTSHTPCGDASIIVISHELGHGSCSDKMARFLQQPIYLSAVVVCPFSQDAM
ERALYNRCHKVLSLAAVSWNTFRELVQKQRSEYWDYKAAAYQEAWNCLRQ

>U3JIM9_FICAL/63-494
(SEQ ID NO: 242)
AMGTGTKCIGRNKMRKTGDILNDSHAEVVAKRSFQRYLLHQLWLIFSPGTETGKWK
LKPNIIFIFFSSHTPCGDASIFISEPELSKNSCSDKLARFLQYPVYLSAVIVCPYSQEAMR
RAVIERCQHVSSLAAISWHKFQRLMTEDLPDYWDYKQAAYQEAWRVLRS

>ADAT1_CHICK/63-496
(SEQ ID NO: 243)
ALGTGTKCIGLNKMRKTGDVLNDSHAEVVAKRSFQRYLLHQMRLIFIPGTETGKWK
LKPNIIFIFFCSHTPCGDASIIIRETELSKSSCSDKLARFLQYPVYLSAVIVCPYSQEAMQ
RAVIERCRHISLLAAISWHEFQKLVTENLPDYWDYKEAAYQEAWKALRS

>U3IY34_ANAPL/63-495
(SEQ ID NO: 244)
AMGTGTKCIGQNKMRKTGDILNDSHAETVAKRSFQRYLLHQMCLIFIPGTETGKWK
LKPNIIFVFFSSHTPCGDASIIISEPELSKNSCSDKLARFLQYPVYLSAIIVCPYSQEAMR
RAIIERCQHVSFLAAISWHAFQKLVTENLPDYWDYKEAAYQEAWKVLRS

>F7EEN0_ORNAN/78-517
(SEQ ID NO: 245)
AMGTGTKCIGQSKMRKDGDILNDSHAEVIAKRSFQRYLLHQIEAIFIPGTEVGKWKL
KPDLSFVFFSSHTPCGDASIIMLDVEPCPRSCSDKLARLLQDPVYLAAVVICPYSPEAV
RRAVIDRCRHVSPLAAISWGAFQKLVGDKQPAYWDYKEAAYQETWKALQR

>F7G3V9_MONDO/64-497
(SEQ ID NO: 246)
SMGTGTKCIGLSKMRKNGDILNDSHAEVIAKRSFQRYLLHQLRSIFMPGTKTGMWK
LKPDLHFVFFSSHTPCGDASIIMLELEPCSHSCSDKLARFLEEPVYLAALVICPYSPEA
MKRAVIDRCQHVSSLAAISWNLFQNLVSSKRPEYWEYKEAAYQEAWKTLQK

>G1T9N5_RABIT/63-492
(SEQ ID NO: 247)
SMGTGTKCIGQSKMRKSGDILNDSHAEIIAKRSFQRYLLYQLHMIFVPGTQRGLWKL
RPDLSFVFFSSHTPCGDASIIMLEFEPCCSSCSDKVARFLEEPIYLSAVVICPYSQEAMQ
RALLGRCQNVSALAAISWRSFQKLLSDKWPDYQEHKEAAYQEAWRTLRK

>G1Q6Y1_MYOLU/63-485

(SEQ ID NO: 248)
SMGTGTKCIGQSKMRKSGEVLNDSHAEVIARRSFQRYLLHQPHLIFIPGTQRGLWKL
RPDVFLFVSSHTPCGDASIIMLEFEPCYSSCSDKLARFLEEPVYLSAVVICPYSQEAMQ
RAPVRRCRMSPLYAAISWRSFQELLSDKWPDYQEYEEASYQEAWSALRK

>F6Z5W8_HORSE/63-490
(SEQ ID NO: 249)
SMGTGTKCIGQSKMRKSGDILNDSHAEIIARRSFQRYLLHQLHLIFVPGTRRGLWKLR
PDLLFVFFSSHTPCGDASIIMLEFEPCCSSCSDKLARFLEEPIYLSAVVICPYSQEAMQR
ALTGRCHNISALAAISWRSFQKLLSDKWPDYQEYKEAAYQEAWSALRK

>M3YEQ1_MUSPF/71-497
(SEQ ID NO: 250)
SMGTGTKCIGQSKMRKSGDILNDSHAEVIARRSFQRYLLHQLHLIFVPGTQRGLWKL
RPDLSFVFFSSHTPCGDASIIMLEFEPCCSSCSDKLARLLEEPVYLSAVVICPYSQEAM
HRALTGRCQNVSALAAISWRSFQKLLSDKWPDYHEYKEAAYQEAWSALRK

>ADAT1_MOUSE/63-492
(SEQ ID NO: 251)
SMGTGTKCIGQSKMRESGDILNDSHAEIIARRSFQRYLLHQLHLIFVPGTQRGLWRLR
PDLSFVFFSSHTPCGDASIIMLEFEPCCSSCSDKMARFLEKPIYLSAVVICPYSQEAMR
RALTGRCEETLVLAAISWRSFQKLLSDEQPDYQEYKDAAYQEAWGALRR

>H0VKI8_CAVPO/62-489
(SEQ ID NO: 252)
SMGTGTKCIGQSKMRKSGDVLNDSHAEVIARRSFQRYLCHQLQLIFVLGTQKGQWK
LRPGISFVFFSSHTPCGDASIIMLGFEPCYSSCSDKVARFLEEPIYLSAVVICPYSQEAM
HRALIGRCQNISALAAISWRSFQKLLSDMWPNYQEYKQAAYQEAWSALRK

>G7Q1N8_MACFA/63-495
(SEQ ID NO: 253)
SMGTGTKCIGQSKMRKSGDILNDSHAEVIARRSFQRYLLHQLQLIFVPGTQKGLWKL
RRDLFFVFFSSHTPCGDASIIMLEFEPCCSSCSDKMARFLEEPIYLSAVVICPYSQEAM
QRALTGRCQNVSALAAISWRSFQKLLSDKWPDYQDYKEAAYQEAWSTLRK

>I3MW85_ICTTR/63-492
(SEQ ID NO: 254)
SMGTGTKCIGQSKMRKSGDILNDSHAEVIARRSFQRYLLYQLQLIFVPGTQRGLWKL
RPNLLFVFFSSHTPCGDASIIMLEFEPCCGSCSDKMARFLEEPIYLSAVVICPYSQEVM
QRALIGRCQNVLALSAISWRSFQKLLSDKWPDYQEHKEAAYQEAWSALRK

>D8SUQ7_SELML/51-383
(SEQ ID NO: 255)
ALGTGTKCLGGSQRSLAGDTINDCHAEVIARRTLLKLLYTDIGSNGRLRMRPEIRLHL
YISQSPCGDACGVDSCSDKIARFLNEPVYISTITVSDLACIEALQRATFGRLCSVARNY
SISWRSFRHLLTHFFPGYLECKKLAYLEAKEILLH

>M0SLB0_MUSAM/69-408
(SEQ ID NO: 256)
ALGTGTKCIGGSLLSPTGDVVNDSHAEIIARRSLLRYFYAEIERAFDTSCCGQTKYRM
NPGWGLHLYITQLPCGVFSYPTLRELSCFNKITRILQPVYLSTLTVSVKTNYLEKAIYD
CMERLHIKYSICWEVFVSLQSRLSLQYHGLKAMAYQSSLKMLR

>M1BYG7_SOLTU/64-418
(SEQ ID NO: 257)
SLGTGTKCIGRSRRSSKGDVVNDSHAEIIARRALLRYLYSEIQDMFESDGLGTKKLK
MKHGWQLHLYISQLPCGVASPGSELAHDSMSCSDKIARFLEPIYIFSVTISIIEDEVMR
AIHERVLPLSNKYSICWESFLSLSHNCVGEYRELKDKSYNLASETFK

>K7KC56_SOYBN/58-388
(SEQ ID NO: 258)
AMGTGTKCLGRSLLRTCGDVVHDSHAEVIARRALIRFFYTQIQPFDPGCLNKGKYSL
KKDWKLHMYISQLPCGDASLSVSPLSCSDKIARFLQPVYLSSITVFRLEDSLKRALYE
RMLPLSNEYSICWEVFLSLGPENLIGYRELKDGAYHLASKIFK

>F4HU58_ARATH/50-411
(SEQ ID NO: 259)
ALGTGTKCVSGSLLSPRGDIVNDSHAEVVARRALIRFFYSEIQRSIDSSCPGEVKYKLK
SGCLLHLYISQLPCGYASTSSPLYKKISCSDKIARVLQPVYISTITVFSLADHLRRSLYE
RILPLSDEYSLCWELFLKETHGHKREYRELKNKAYYLMSKIFK

>W4XXD3_STRPU/717-1055
(SEQ ID NO: 260)
SLGTGNRCVTGDKLSMEGRTVNDSHAEIITRRAFLRYLYNQLQAILTQGTNGKLRLL
PDVSLHLYISTAPCGDGAQFSRTDENESSCSDKVASFIEPMYLSSISLSLYHHGHLARA
VCCRVSSELDNLLSINWSEYQQTCRLFDRTYHDAKLSAYYTAKQYLKC

>I1GJ01_AMPQE/629-965

```
                                           (SEQ ID NO: 261)
SFGTGTRTASGDLLDLKGEVVFDSHAEIIARRGLKMFLYQELQVIFEANEDGKLRVK
KSIKFHLYISTAPCGDGAQFSRLDNRLSSCSDKIGSFVEPVYLFSLSLSLHHHGHLSRA
VCCRFHELGPYLSMNWNEFLSLSSVSGHTYAEAKSLAYQEAKGLLHK

>A7REZ9_NEMVE/161-491
                                           (SEQ ID NO: 262)
SLGAGNRCVTGQRLSMEGKVVNDSHAEIIARRSLLRFFYAQLHAIFEKNNSRRLAVR
QGVSFHLYISTAPCGDGALFTPRENTDLSCSDKICRFIEPVYLESLTLYLYDHGHLAR
AVCCRLQDLGAELSVNWESFKELCQRTDREYSQAKQMAFQNAKRELFE

>K1PWV0_CRAGI/737-1070
                                           (SEQ ID NO: 263)
SIGTGNRCITGPQLSLEGNTVNDSHAEIITRRGFIRFMYKQLQALFEPSPSGKLRLKDNI
TFHLYISTAPCGDGALFSPRDSNNASCTDKLCRLMDPVYLDSLTLLLYDHGHLARAM
CCRLARDINSLLSVNWDNFKQVCADLGKQYGKAKTAAFQTAKKALIK

>T1J5P4_STRMM/754-1087
                                           (SEQ ID NO: 264)
SMGTGNRCISGERLSQEGLVVNDSHAEIVTRRGFLRFLYKQLIEIFEPSENRKFRVKPD
VTFHLYISTAPCGDGALFSKTDVSELSCSDKIARFVDPIYLTSITLYLYDHGHLSRAVC
CRLSELDTLHSLSWASFKEACIKHQRDYYLVKTAAFQKAKKVLLE

>M4A7Z3_XIPMA/994-1320
                                           (SEQ ID NO: 265)
SLGTGNRCVKGEELSLKGETVNDCHAEIISRRGFIRFLYSELLKIFEPAEENKLKIKPDI
TFHLYISTAPCGDGALFDCSEKSCSDKILRFLHPIYLKSITLYLYSHGHLTRAVCCRLA
RAFSQNSSVNWCLFRSLCQRCGRTYAQAKTSAFQLAKQQFFE

>M3XGS0_LATCH/812-1140
                                           (SEQ ID NO: 266)
SIGTGNRCVKGEELSLKGETVNDCHAEIISRRGFIRFLYSELMKFLEVVSDGRMKIKT
GVTFHLYISTAPCGDGALFDCSEKSCSDKILRFLHPVYLSSVTLYLYSQGHLARAICC
RMSRAFQEGSSVNWQLFQQICTKTDRKYQEAKEAAFQKAKVHFVQ

>U3IQ81_ANAPL/729-1061
                                           (SEQ ID NO: 267)
SIGTGNRCVKGEELSLKGETVNDCHAEIISRRGFVRFLYSELMKIFEPAGKKRLKIKSN
VTFHLYVSTAPCGDGALFDCSDKSCSDKILRFIEPVYLSSVTLYLYSQGHLTRAICCR
MVRVLQKRSSVNWALFQQLCAKNKRKYSEAKEAAYQEAKQRFFS

>F6ZMB0_XENTR/760-1089
                                           (SEQ ID NO: 268)
SIGTGNRCVKGEELSLRGETVNDCHAEIVSRRGFISNTIXSQLMKIFEEAEGDLLRVRP
GVTFHLYISTAPCGDGALFDCSDKSCSDKILRFMEPVYLSSLTLYLFSQGHLTRAICCR
MSRAFQNQSSVNWTLFQQLSVLRGRHYSDVKATAYQTAKGQLFR

>F7GMY9_MACMU/591-920
                                           (SEQ ID NO: 269)
SLGTGNRCVKGDSLSLKGETVNDCHAEIISRRGFIRFLYSELMKIFEPAKGGEKLQIKK
TVSFHLYISTAPCGDGALFDCSDKSCSDKILRFLQPIYLKSVTLYLFSQGHLTRAICCR
VTRAFEDGTSVNWLLFKKLCSFRYRRYGEAKKAAYETAKNYFKK

>C3YCU6_BRAFL/320-659
                                           (SEQ ID NO: 270)
AMGTGNSCVMGKNIGTDGRTLNDCHAEVVVRRSLLRYLYRELKNIFEKHSDSLLVL
KEGVSFHLYLTTAPCGDAATHITRDTRVQSCSDKLAKFIEPVYLSSVTFTNYDHGQLS
RALCCRIDDHISADISLNWMRFKAMCTLARRQYNQAKMMCYQEAKRQLYD

>H3ABU2_LATCH/179-499
                                           (SEQ ID NO: 271)
ALGTGNSCYAGWLAFDGRLLHDCHALVVVRRTLQRFLYKQLLLIFCSSPGGSLSLRP
GIFFHLYLGKVPEGAARTTFMYAPRNPSESDKMTRFIQPIYITSVVLHFYDRNTVSQVI
NKRLEGALIRKSSLNWSSFRKVAEKTGRSYHSVKLRAYQKVKKQVNC

>H9G4E7_ANOCA/55-372
                                           (SEQ ID NO: 272)
ALGTGDICYEGWMEFNGRRVHDMHGMVVARRVLLRYFYKQLLMIFCPAGDGILAL
KPKYFLHLYLSRTPSGASENFHLAPVVQSGSDKLTRIILPVYITSVVLPYQDHTVLHE
VVNDRVQLGPGNGLSLNWSMFRKVVQEMKREYHKGKVQAYQSAKLQMYT

>GINZA7_MYOLU/269-591
                                           (SEQ ID NO: 273)
ALGTGSSSCAGWLEFSGRQLHDCHGLVVARRALLRFLYRQLLLVLTPQPGPGFVLKP
RIFIHFYISNTPKGAAHDIYPPAASASDKLSRFLPPLYATSLVLPCHDPPTLSSAIHTRL
DRVSGSCLSLNWRAFRQAAQALGKSYEEAKAYQEARQQLSL

>F1M8B2_RAT/237-552
```

(SEQ ID NO: 274)
ALGTGSSSCAGWLEFSGRRLHDCHGLVIARRALLRFFFRQLLLVLTPQPGSGFALKPG
VFLHLYVSNTPKGAAHDIYLASPSASDKLARFLPPLYATSLVLPCHDPPTLNRAIHSR
LDSVLGSCLSLNWAAFRQVARALEKPYEAAKAYREARQQLSL

>H0X0C9_OTOGA/275-589
(SEQ ID NO: 275)
ALGTGNSCCAGWLEFSGRQLHDCHALVVARRALLRFLYRQLLLVLAPQPGPGFALK
PRIFLHLYVSNTPKGAAHDIYSASTSASDKLARFLPPLYSTSLVLPCHDPSTLSRAIHSR
LDGALGPVLSLNWRAFRQAAGALGKPYEAAKAYQEARRRLSL

>F6QYL4_MACMU/258-573
(SEQ ID NO: 276)
ALGTGSSCCAGWLEFSGQQLHDCHGLVIARRALLRFLFRQLLLVLAPQPGPGFTLKP
RVFLHLYISNTPKGAARDIYPTSPSASDKLARLVSPLYSTSLILSCHDPPTLSRAIHTRL
DSVLGPCLSLNWRAFHQVARAVGKPYEAAKAYQEARRQLSL

>H3A635_LATCH/258-579
(SEQ ID NO: 277)
ALGTGDFNYSQCICRDGRVVHDSHGVVMARRSLLRFLYRQLLLIFCIEPTSKLTIKPN
ANIHLYLNQLPKGAAQIKSQLRPQSQSASDKLTRFIQPVYISSVLIANCTDTRGLEIAV
KQRVDDALTSRLSLNWSRFNLLAKESNREYHDAKIMSYQEAQCLLKS

>H2PE88_PONAB/193-512
(SEQ ID NO: 278)
AIGTGEYNYSQDIKPNGRVLHDTHAVVTARRSLLRYFYRQLLLIFCTEPTSNLTLKQN
INICLYMNQLPKGSAQIKSQLRPHSESSSDKLTRFIQPVYISSILVGNCSDTRGLEIAIKQ
RVDDALTSKLSLNWSRFNLLAKEAKKYHAAKCMSYQEAKCKLKS

>H0VR27_CAVPO/289-609
(SEQ ID NO: 279)
AVGTGEYNCSQCIKPNGRVLHDTHGVVTARRSLLRYFYRQLLLIFCTEPASDLTLKQ
DINIYLYMNQLPKGSAQIKSQLRPNSESSSDKLTRFIQPVYISNILVVGNCSDTRGLEIA
IKQRVDDALTSRLSMNWSRFNLLAKEAKRDYHAAKCMSYQEAKTLLKS

>GINDQ0_MELGA/165-484
(SEQ ID NO: 280)
ALGTGDCNYSNDYSPEGRVVHDSHAIVTARRSLLRYFYRHLLLLFCTAPDSKLTLKR
NISIYLYMSQLPKGSAQIKTQFCPHSESASDKLTKFIEPVYINTILVGNCRSLKGLEIAIR
QRIDDALTSKLSLNWSRFKCLAGRAKRTYHEAKVKSYQEAKKLLHS

>U3IGD7_ANAPL/256-575
(SEQ ID NO: 281)
ALGTGQCNYSQDYQPNGRVLHDSHAIVTARRSLLRYFYRHLMLIFCTAPGSKLVLK
QNTNIFLYMNQLPKGSAQLKSQLHPQSESATDKLTKFIEPVYINSILVGNCKDTRGLEI
AVKQRIDDALTVELSLNWSRFKSLAKEAERNYHKAKIQSYQEAKKLLHS

>H0YUT0_TAEGU/165-484
(SEQ ID NO: 282)
ALGTGECNYSRRFESCGRLLHDSHAVVTARRSLLRYFYRHLLLIFCTAPGSKLTLKR
NITLSLYMNQLPKGTAQLESEVHPQSESAGDKLTKFIEPVYISNILVGSCKDTKGLDIT
IKQRLDDELTSKLSLNWSRFRMLAREAGRDYHEAKVKSYQEAKSLLQS

>W5M4T6_LEPOC/238-558
(SEQ ID NO: 283)
AIGTGDTNTNQHATANGRLLHDSHAVVTARRSLLRYLYRHLLLIFQLDLNSQLTLKR
NITIHLYMNQLPKGSAQLPPRLHPCSNSASDKITQFIEPIYVGSILIASCSDVRGLEIAV
KQRVEGITSKLSMNWSRFNLVAKEAEREYYEAKMSSYQEAKIVLKT

>F1RC56_DANRE/229-549
(SEQ ID NO: 284)
ALGTGSSNTKASPAPTGRILHDSHAVVTARRSLMRFLYRNLLLVFQQDETTKLSFKN
HITLHLYLSQLPKGASQIPSQLRPLSNSATDKVMQFIEPIYMSSIFIGSCSDIRGMEMAV
NQRVDGITSALSLNWRFNLVAKESQREYREAKMMAYQEAKSMLKS

>W5LAE0_ASTMX/254-574
(SEQ ID NO: 285)
ALGTGNLNTKESLTPSGRILHDSHAVVTARRSLMRYLYRHLLLIFQQDQNTKLSLKS
HITLHLYLNQLPKGAAQIPSHLRPLSNSATDKITQFIEPIYVSSILIESCSDTRGMEVAIN
QRVDGITSKLSLNWSRFNLVSKEAQREYREAKMMAYQEAKSVLKS

>H2N2Y7_ORYLA/166-486
(SEQ ID NO: 286)
ALGTGGFNTRESISSDGRIVHDSHAVVTARRSLMRYLYRNLLMVYQHKSNSNLSLKT
GISLHLYVNSLPKGAAVIPSKLYPLSSSTADKITQFIEPIYQSILISCCTDVRGMEVSV
CQRVEGVTSQLGINWHRFKLVAKEAQRHYREAKRMAYQEAKSVLRA

>G3PWS7_GASAC/162-482

-continued (SEQ ID NO: 287)
ALGTGNFNAKESASTGGRIVHDSHALVSARRSLMRFLYRHLLMVFEQSGSGLSLKSG
ITLHLYVNQLPKGAAQIPSQLRPLSNSATDKLTQFIEPVYVHSILVVGCSDVRGLKMS
VSQRVEGITSQLGINWHRFKLVAKEARRLYREAKRMAYQEAKNVLRA

>E4WSB5_OIKDI/481-800

(SEQ ID NO: 288)
ALGTGTKTMTGDYISSIGTAVIDCHGEIISRRNLKRYFYAELQKIFERKDGQFALRDGI
KFHLYINTTTCGDARVFNPNSDFESSCSDKVMRLIEPIYLSSISLGLYHRQHFPRAMFE
RIDDIGLDFSINWQLYLLGYATKIYLDAKNLSYQSVKNGLYE

>X1WRM4_ACYPI/235-549

(SEQ ID NO: 289)
CLATGTKCLSGNYLSLSGESLHDCHAEILTRRCLLKFFYKELMEIFVFSGDKKFKLAE
DIAFHLYINTAPCGEARVFSFCDENSCSDKLTLFIEPTYLESISISVFNINHMKRTIYGR
VENSIDKYCVNWKEYIKLCSLSTLIYDLLKNKNYIAAKNQILS

>H3EEX4_PRIPA/256-594

(SEQ ID NO: 290)
SLATGNKCIKATSLSFDGCAVNDCHAEILTRRGLVRWLYTQVQLLVEQGEEGGKLR
LRKRFSLHLFISTAPCGDGRVYQFGSNKDNSCSDKVLKFLHPLLICLSIYLSSLAHFT
RESCIARACYGRVARFKPVSANWTRFAALTPYKDVKRSAYSKTQFELIR

>H2W2W9_CAEJA/169-490

(SEQ ID NO: 291)
SLSTGNKGLRGDKVVSDGTALIDCHAEILARRGLLRFLYSEILKIFMKKGTL VLRPGIS
FHLFINTAPCGAGRIDNKAKSVKASCSDKLLRFVEPIYYSSIAVEKNNVERLQRAVFG
RAASSSVNWELMVHVCAITQTYDELKAGCYETEKKAFIA

>A8WK36_CAEBR/168-488

(SEQ ID NO: 292)
SLATGNKGLRGDQITSDGSALIDCHAEILARRGLLRFLYSEVLKIFETGKLALRQGISF
HLFINTAPCGTARVDRKVRTAEASCSDKLLRFIEPVYYASIAVEQNNFVRMNKAVYT
RASSGSMNWELMVKTCFLTKTYEEMKAGCYSAAKKSFIM

>G0MG92_CAEBE/170-489

(SEQ ID NO: 293)
SLATGNKGLSGDKIRSDGSALIDCHAEILAKRGLMRFLYSEVLKIFLESGLILKLGITF
HLFINTAPCGTARVDKKMRNPESSCSDKLLRFMNPIYYSSIAVEKSNFERMNRAVND
RAAGGSMNWELMKTVCTLAKIYEELKAGSYAATKKEFYA

>E3NFH7_CAERE/177-503

(SEQ ID NO: 294)
SLSTGNKGLRGDKIVNDGSALIDCHAEILARRGLLRFLYSEVIKIFERGTLVLKKGILF
HLFINTAPCGTARVDRRMKTAEASCSDKLLRFIEPIYYTSIAVEQNNFDRINKAVFAR
AANGSMNWELMMATCKLTQTYDELKAGSYLNAKQSFIK

>ADR2_CAEEL/167-486

(SEQ ID NO: 295)
ALSTGNKGLRGDKIVNDGTALIDCHAEILARRGLLRFLYSEVLKIFTKGKLVLKPGISF
HLFINTAPCGVARIDKKLKTSDNSCSDKLLRFIDPIYYSSIAVELNNADRLRKAVYSR
AATSSMNWELMITICTLTKTYEELKAGSYAAAKKSFIT

>A7SFG1_NEMVE/255-570

(SEQ ID NO: 296)
SIGTGTKFISGEYISDKGYAVNDCHGEIIARRGLRKFLYNQLELIFELKPSGYGLKDQV
EFHLYISTSPCGDARVFSPHEPEEKSCSDKICKFIEPVYFTSIILSLYRYNHMARAMYE
RVGPVEDHSLNWTKFLALWARQYDEAKLSAYQKAKASLMM

>T1I1Q0_RHOPR/253-578

(SEQ ID NO: 297)
SVGTGTKCVGGEHISVKGAVLNDSHAEIISRRGLVRYFYSQLLLIFIRNEDGQFCLKPE
IRFHLYISTSPCGDARIFSPHDNTSSCSDKVAKFIEPIYLHSIVVSLFHQTHLRRALYGRI
ENTLIGHSINWIKFHELLRKTGITYSDAKELVYKDAKTYMIA

>D6X3T2_TRICA/272-590

(SEQ ID NO: 298)
SVTTGTKCISGEHISMNGCSLNDMHAEILSRRCLITYFYDQLELIFTQREDGKYKLKP
GLDFHLYINTAPCGDARIFSPHEEASSCSDKICRFIEPIYLKSIVLSLMREAHMYRALC
GRIENTIQGFAVVWKRFARLVGSVTEIYCDVKDAVYKAAKTNLYE

>E2BL35_HARSA/335-651

(SEQ ID NO: 299)
CVTTGTKCVSGEHLSVSGGAVNDCHAEVVARRCLCEYLYKQLELILEPAKKGFKLK
QGIQPHLYINTAPCGDARIFSPHEESASCSDKIARFIEPIYPHSIVLSLLNPSHMYRAVC
GRIENTIQGYSVNWRRFFNLLGTIEDVYLEAKLSVYSLAKRQLKD

>B4MGV3_DROVI/350-668

-continued (SEQ ID NO: 300)
SVSTGTKCVSGEHMSVNGAVLNDSHAEIVSRRCLLKYLYAQLDLIFVRNTDGQYKL
KSGVHFHLYINTAPCGDARIFSPHETGASCSDKIARIIEPVYLHSIVLSLLHPEHMYRA
VCGRIEKSIQGFGINWDKYGFLMKGMQYGETKADVYQTAKQELFS

>Q17109_AEDAE/283-612

(SEQ ID NO: 301)
SLATGTKCVSGEHMSVTGSVINDSHAEIIARRGLLDFFYTQLDLIFVAPTDGTYKLKD
GIHFHLYINTAPCGDARVFSPHENMDASCSDKISRVIEPIYLHSIVLSLLHPAHMYRAI
CGRIENSIQGFSINWRRFAAVIEHARYGETKMCVYQQAKKELFA

>K1QNQ5_CRAGI/353-676

(SEQ ID NO: 302)
SVSTGTKCINGEYMSDQGLAVNDCHAEVIGRRSLMRYLYFQLGKIFQEKEGGFMLK
PNIHFHLYISTSPCGDSRIFSPHEQEASCSDKIARFIEPVYFDSLILSLYHGDHLSRAVYS
RISNIENFAVNWKRFLQLCGLTGQSYADAKVTVYQTAKQQMYL

>C3XSL3_BRAFL/39-363

(SEQ ID NO: 303)
SLATGTKCINGEYMSDQGMALNDCHAEIVSRRSLLRYLYSQLDLVFEPKEDGKYRL
KDNIQFHLYISTSPCGDARIFSPHETDASCSDKIARFVEPIYLSSIILSLYHGDHLSRAVY
QRLGELEQFSVNWQCWNKLFGTTGRHYSEAKLLNYQAAKQEMVK

>H2QL56_PANTR/370-731

(SEQ ID NO: 304)
SVSTGTKCINGEYMSDRGLALNDCHAEIISRRSLLRFLYTQLELIFQKSERGFRLKENV
QFHLYISTSPCGDARIFSPHELEAASCSDKIARFVEPIYFSSIILSLYHGDHLSRAMYQRI
SNIEDFSVNWCRWMRVHGHLLRSYHESKLAAYQAAKARLFT

>F7DBJ2_HORSE/369-690

(SEQ ID NO: 305)
SISTGTKCINGEYMSDRGLALNDCHAEIIARRSLLRFLYTQLELIFQKSERGFRLKENV
QFHLYISTSPCGDARIFSPHELEASCSDKMARFVEPIYFSSIILSLYHGDHLSRAMYQRI
SNIEDFSVNWCRWMRVHGNLLRSYHESKLAAYQAAKACLFK

>H3CU13_TETNG/420-741

(SEQ ID NO: 306)
CVSTGTKCINGEYMSDRGLALNDCHAEIIARRSLIRYLYSQLEFIFVHYEKGYRLKDN
VQFHLYISTSPCGDARIFSPHEVEASCSDKIARFMEPIYFSSIILSLYHADHLSRAMYQR
IADIEDFSVNWSRWVRLHSSILSNYHEAKQAAYHSAKQALIK

>H2N2D8_ORYLA/315-637

(SEQ ID NO: 307)
CISTGTQCIDGEHLSEDGLTVNDCHAEVVARRCLVRFLYSQLELIFRRGECGRFRLKD
KVQFHLYVSASPCGDACIFSPHDVETSCSDKMARFTEPLYFSSIIVSLYHAAHMSRAM
YGRIGPLEGFSENWCRWMQLHSSFLRVYHQAKRAAYCSAKHTLYR

>I3JK85_ORENI/388-710

(SEQ ID NO: 308)
CVSTGTKCIGREYMSNRGLALNDCHAEIVARRSLIRFLYSQLEYIFMRCDNSQFRVKE
NVQFHLYISTSPCGDARIFSPHEVDASCSDKIARFTEPIYFSSIILSLYHADHLSRAMYQ
RITEIEEFSVNWSRWMNLHCSMLWIYHDTKQAAYHSAKETLFR

>H2N9L5_PONAB/404-725

(SEQ ID NO: 309)
ALSSGTKCISGEHLSDQGLVVNDCHAEVVARRAFLHFLYTQLELIFVRLKEGYRLRE
NILFHLYVSTSPCGDARLHSPYETDESCTDKIARFVEPVYLQSIVVSLHHTGHLARVM
SHRMEGVGQFSVNWARWAQLYGTRTPSYCEAKLGAYQSVKQQLFK

>F6VCE0_XENTR/367-729

(SEQ ID NO: 310)
ALSSGTKCINGEYLNDQGLVVNDCHAEIIVRRAFLHFLYTQLELIFIRLKEGYRLRENI
MFHLYVSTSPCGDARLHSPYESDESCTDKITRFIDPIYLQSIIVSLHHTGHLSRVMSHRI
EDLGNFSLNWTRWARLYGTRIGNYCDAKLAHYQSVKQQMFK

>H3C3F5_TETNG/393-715

(SEQ ID NO: 311)
ALSTGTKCINGEYLSDQGLVVNDCHAEVTARRALLRFLYSQLEFIFVRHKERYRLRD
NIHFHMYISTSPCGDGRLNSPYESDHSCTDKITRFVEPVYLHSVTISLRHTGHLGRVLN
QRLERLGPMSVNWTRWSRLYRTHASSYAEAKMAAYQSVKQQWFR

>W5LI18_ASTMX/382-706

(SEQ ID NO: 312)
ALSTGTKCINGEYMSDQGLVVNDCHAEVTTRRALLRFLYSHLELKLVQQGRGFRLR
VCVIYHLMAFVADCQTARFASPFFLSFSCTDKIARFVEPVYLSSLTVSLRHTGHLSRT
LSQRLERLGPYSVNWTRWTRLYRACAPGYCEAKQAAYQTAKEHWVR

>X2BQ53_DANRE/411-730

-continued (SEQ ID NO: 313)
ALSSGTKCINGEYISDQGLVVNDCHAEITTRRALLRFLYSQLELIFVRHKDSLRLREN
VLFHMYISTSPCGDARVNSPYESDFSCTDKISRFVEPVYLYSLTVSLRHTGHFSRMMN
HRMEKAGPYSVNWARWVRLYRVRGASYCEAKQAAYQTVKLQWLK

>W5N363_LEPOC/428-750

(SEQ ID NO: 314)
AISTGTKCINGEYISDRGLVVNDCHAEIIARRAFVRFLYSQLELIFIRHKEAYRLRENIL
FHMYISTSPCGDARLNSPYEADESCTDKITRLVEPVYLHSLIVSLHHTGHLSRIVTHRL
DRMGHFSVNWARWAKLYRTQVPNYCEAKLAAYQTVKQQLFK

>H2LP25_ORYLA/349-671

(SEQ ID NO: 315)
SLATGTKCLDLEDESDSGRILRDCHAEVISRRALVRFLYAQLELIFVRNKDNFRLQEGI
LFHMYVSSSPCGDARLNCPYEAAFSCTDKLAKLVEPIYLHSLTVTLCHTGHLARGMA
RRLTPVKHISLNWTRWLQLQRGPVSGFSACKMSAYQRALRRFGS

>I3KMJ4_ORENI/382-706

(SEQ ID NO: 316)
SLATGTKCLDLGGVSDSGCTLTDCHAEVVSRRALVRFLYSQLELIFIPNKSCGDFRLR
EGVHFHMYVSSSPCGDARLNCPYEAAFSCTDKLAKLVEPVYLQSLTVTLSHTGHLG
RAMARRLAPIKHISVNWARWLRLQQGPVIGYCASKMSAYQRAVQQFSS

>M3ZX42_XIPMA/284-606

(SEQ ID NO: 317)
SLATGTKCLDLDRLNEDGWTLRDCHAEVLSRRALVRFFYSQLELIFVPDKDSTHFRL
QEGIRFHMYVSLSPCGDARLNCPYEPAFSCTDKIAKLVEPIYLHSLTVRLSHTGHLGR
AVTRRLARVKHVCVNWSCWLRLENTPVSGYQASKMGAYQKAMQQFSN

>G3PZQ1_GASAC/403-718

(SEQ ID NO: 318)
SLATGTKCRDSDGVGDREGTLSDCHAEVLSRRALVRFLYAQLELIFVSNTAGGFRLR
DGVFFHMYASSSPCGDARLNCPHEAAFSCTDKIAKLVEPVYLHSLTVTLSHTGHLGR
AVARRLAPVRRIKIIAARSRDVLTRHLNSYSGSKMAAYQRAMQQFTG

>H3CRD2_TETNG/277-601

(SEQ ID NO: 319)
SLATGTKCRDRGSAADGAGSLSDCHAEVISRRALLRFLYSQLELVLTPKPGGYRLRD
GLLFHMYVSCSPCGDARLNCPYEAAFSCTDKLAKLIEPVYLQSLTVTLSHTGHLSRA
LTRRLAPVRRTSSNWARWRRLQQAHLDGYAGWKAAAYQRVMQTESS

>H2S0X8_TAKRU/296-626

(SEQ ID NO: 320)
SLATGTRCPGRAGARDRAGTLSDCHAEVISRRALLRFLYWQLELIFTPNSGGCRLRD
GVLFHMFVSSSPCGDARLNCPYEAAFSCTDKLAKLIEPVYLHSLTVTLSHTGHLSRA
MARRLAPVRQISTNWVRWQQLQQPQLNGYSGWKGAAYRRMMQNFIS

>K1RR67_CRAGI/135-316

(SEQ ID NO: 321)
KYPSRTYYKQTCIVCNITTGENTLFKLAKSDGKHAEELLLEELEKLVPKDSLTITIFMN
DTPCSLAGHDCAGKFVQYLKTAKVDLTLYVTSLCESKKKDIHKGLAGLKQCTVKSP
NRDAWQEFIMDLNDWKKYEKQEKDGIEK

>K1QUE8_CRAGI/4-176

(SEQ ID NO: 322)
NLDHQDWDKAKSCLICKIDDNITVLEKTEGTHAEEFLLQELEKKVRNVTIFMNNSPC
STPNHTCADKLLKYLDASENVRMTMYVTRLYMIARDGHHAGLQRLKQHACEINAF
NKNWEELITKMEFKEYNVRSRKEED

>A0A0W0VFJ2_9GAMM/61-217

(SEQ ID NO: 323)
YGNSKEQLFMLAKIPELFPESRHAEENLILGFSGIEQFFPEQIRKIDIFLSHSPCSEQGVK
CSGSLYLNGCDQKLIAFFKKGNDLDRSLFLENSNVQVRYHRQFDSAVENFIIQAPELK
DWKN

>A0A0W0XR23_9GAMM/33-206

(SEQ ID NO: 324)
ISNELQVSAPKKKQRLFMLDNVPAVFPESNHAEENLIRRFPDVSQFFPGQIINITIFLSH
SPCCAEGEKHSDARPINGCNKKLSVFFEKGNALDASLFVNTKFKVQYLYRFNHTVEP
FIRQAPLLH

>A0A0W0S272_9GAMM/47-207

(SEQ ID NO: 325)
IGNELSKQDTPRKHQLFMIAKVPQLFPQHAQHAEENLIRGFPSINKFYPNQISKIDIFLT
HSPCSEEGGKHSSQNSVNGCDKKLTVFFKKGNSADVQLFNRNTKVKVYYNHKFDS
ATDEFIKEAPI

>A0A098GDC1_TATMI/41-209

-continued (SEQ ID NO: 326)
IGNELKNSDLDRKQKLFMIGGVPQQFPRHSQHAEENLIRNFPNIKKFFPNQINTVEIFL
THSPCSSNGQKYSAQCYTNGCDKKLSAFFKKENYFDQQLFNRKVKVRIHYNHQFDP
SINHFIKEAPILK

>A0A0M0LPN3_9EUKA/47-262

(SEQ ID NO: 327)
ERFLNAPLVRKPNTILMLRVQSEEMYLCYTRGYANSLHAEQFMMEDPELLRLLQPV
RTLLMTLLMTQQPCHENAHASCTLRLLRWCKRERGIDLSIRIARVFRAADESARDGL
RLLMRAPVEVAMLTCEDWQHCDERLVAFRPWHEMED

>C1E186_MICCC/53-299

(SEQ ID NO: 328)
FFHCSPTPEARKTKGVVVAALRRGDLRSNSSHAEEYVVRDEELVRAVAPEDAGTLT
LYQRLQPCHGSSDNRGSCSDAVAGLHRELLGVSLRVAVSYTYRAHVRGFREGIRVF
AADGVTLEALNAEDWALCDEDYAAAFGGVFTAAVAHRRAMDE

>A0A0M0K2Z4_9EUKA/249-414

(SEQ ID NO: 329)
PPPNIFLAQTREREAETGLRLLLYMTYQPCHHSGGRPKEALGTCSESLRDFYIKELGV
ALELVLADVYKATEELHREGMRMLLAEGITMRAMQPADWDLCDPEWAKRGAGPF
SKH

>R1E5J9_EMIHU/273-492

(SEQ ID NO: 330)
CGKVVVAVALEHWRAGSSENVHAESFVIADETILSAVVAELTLYLSYQPCHHSGGR
GGGEARQSCTEELIAYHERELNVPLSVVVADLYKVMEELMREGIRRLMSPGMSMRA
TGEEDWALCDQSYERRGGSAFGPHVALRAKLD

>A0A0M0LPN3_9EUKA/390-614

(SEQ ID NO: 331)
RGRRDGPVIVARVLGQSADLYVAYARGRSENVHAEEFMLADPQLLALLDAGGARIL
RLYMSYQPCHHSGGRKTPEDARKSCSERLRAFYEAEMAISLELVVADLYKAMEDLM
RQGILLMVAPGVTMRATDENDWALCDPAYATRGGSAFSRH

>A0A0M0JB66_9EUKA/269-499

(SEQ ID NO: 332)
VDTRDKTKAQVIVARVLGQNADLYVAYARGRSENVHAEEFMLADPQLLALLDASG
ARILRLYMSYQPCHHSGGRKTPEDARKSCSERLRAFYEAEMAISLELVVADLYKAM
EDLMRQGILLLVAPGVTMRATDENDWALCDPAYETRGGSAFSRHE

>A0A183IJ21_9BILA/199-397

(SEQ ID NO: 333)
SCKSFDERGASTMVACLRTTNGTYQEYRATDNDDRHPEEIFHKDMLQARTYVLPLT
HIIVYLPTSPCFHQDCEPQCDVLDACAEQLAIVYRQAKKTDLKMSVKFLASYIGDLY
KQGITMMMNAGIDVEPLGMRDWIELVHNDSTYYFSWKGLLTSYIRQSEIYI

>A0A077Z854_TRITR/190-389

(SEQ ID NO: 334)
RKLQYRGSSALVAQLTETATYRAFVVSEKTIHVEQKFYHQLMDAANFTMPLREVIL
YLPTSPCFHQDCDPLCDVLDACAEALSICYKQIRREELQMTVKFLASYVGDLYKQGI
MSMMEAGLTVEPLNMKDWISLVSTAGTYYRDWENSLADYVMQTQLYI

>A0A085NPE0_9BILA/206-389

(SEQ ID NO: 335)
AQLTETATYRAFVVSEKTVHVEQKFYHHLMDAANFTMPLRELILYLPTSPCFHQDCD
PLCDVLDACAEALSICYKQIQREELQMTVKFLASYVGDLYKQGIMSMMEAGITVEPL
NMKDWISLVSTAGTYYRDWENSLADYVMQTQLYI

>A0A0V0XXU8_TRIPS/513-708

(SEQ ID NO: 336)
LNEQVQKWEHRGASVMVAKLSDQQVYADYFVGDKPQHVEQIFYTELMNADQCQ
MATLRQICLFMPTSPCFHQDCEPQCDVLDACAETLAIVYKQLQNSDLQMTVKFLAS
YVGDLYKQGILCMLQAGISVEPLNRKDWQALVEPDHTRAWDSLLTNYAMQSQFYI

>A0A0VIMSE5_9BILA/488-683

(SEQ ID NO: 337)
LNEQVQKWEHRGASVMVAKLSDQQVYADYFVGDSKPQHVEQIFYTELMNADQCQ
MTTLRQICLFMPTSPCFHQDCEPQCDVLDACAETLAIAYKQLQNSDLQMTVKFLASY
VGDLYKQGILCMLQAGISVEPLNRKDWQALVESDHSRSWDSLLTNYAMQSQFYI

>E5S912_TRISP/108-302

(SEQ ID NO: 338)
PNEQVQKWEHRGASVMVAKLSDQHVYADYFVAETKPQHVEQIFYAELINADQCRM
TTLRQICLFMPTSPCFHQDCEPQCDVLDACAETLAIAYKQLQNPDLQMTVKFLASYV
GDLYKQGILCMLQAGISVEPLSRKDWYALVESDHTRGWDSLLTNYAMQSQFYI

>A0A183CD28_GLOPA/474-665

-continued (SEQ ID NO: 339)
VPKHVQNCEHKHESGLIVTLGDGYIYGDFFHDSNPHVEEQLVAAIYDLSKYKVDLYE
IVIFVSKSPCFHQDCDPKCEVVDACAKLLGLLLSKVRKVDVRMTVKFLYPHLGDLY
KQGILSMLQSGIKVEPLLMKDWSAVMDWAGEYLQWGSHLDRAVAQSQAFI

>H3FBK6_PRIPA/51-311

(SEQ ID NO: 340)
FHVPKHVQSCEHKHESGLIVTLGEDYIYGDFYHESSPHVEEQLVAAIYDLSKYKVDL
YEIVIFVSKSPCFHQDCDPKCEVVDACAKLLGLLLSKVRKVDVKMTVKFLYPHLGDL
YKQGILCMLQAGIKVEPLLMKDWSAIMDWTGEYLQWNNHLDKAVAQSQS

>A0A0N5AZH9_9BILA/14-264

(SEQ ID NO: 341)
FHIPKHVQSCEQKHESGLIVTLGDDYVYGDFYHESNPHVEEQLVAAIYDLSKYKVDL
YEIMIYVSKSPCFHQDCDPKCEVVDACAKLLGLLLSKVRKVDIRMTVKFLYPHLGDL
YKQGILCMLQAGIKVEPLLMKDWSAVMDWSAEYLQWNNHLDKAVAQSQAFI

>A0A0B2VFT1_TOXCA/106-363

(SEQ ID NO: 342)
FHVPKHVQSCEQKHESGLIVTLGEDYIYGDFYHESSPHVEEQLVAAIYDLSKYKVDL
YEMVIYVSKSPCFHQDCDPKCEVVDACAKLLGLLLSKVRKVDVKMTVKFLYPHLG
DLYKQGILCMLQTGIKVEPLLMKDWSAVMDWSGEYLQWNNHLDKAVAQSQSF

>A0A158Q5D3_DRAME/117-306

(SEQ ID NO: 343)
IPKHVQSCEHKNESGLIVTLGDDYIYGDFYHESSPHVEEQLVAAIYDLSKYKVDLNEV
VIYVSKSPCFHQDCDPKCEVVDACAKLLGLLLSKIRKVDVRMTVKFLYPHLGDLYK
QGILCMLQAGIKVEPLLMKDWSTVMDWSGEYLQWNNHLDKAVAQSQSF

>A0A0N5CVT8_THECL/156-346

(SEQ ID NO: 344)
VPKHVQNCEHKNESGLIVTLGHDYVYGDFYHESSLHVEEQLAAAIYDLSKYKVDLF
EAVIYVSKSPCFHQDCDPKCEVVDACAKLLGLLLSKIRKVDVKMTVKFLYPHLGDL
YKQGILCMLQAGIKVEPLLLKDWSAVMDWTGEYLQWNNHLDKAVAQSQSF

>J0XJI9_LOALO/138-380

(SEQ ID NO: 345)
FHLPKHVQSCEHKNETGLILTLGDDYIYGDFYHESSLHVEEQLVAAIYDLSKYKVDL
FEAVIYVSKSPCFHQDCDPKCEVVDACAKLLGLLLSKIRKVDVKMTVKFLYPHLGDL
YKQGILCMLQAGIKVEPLLMKDWSAVMDWTGEYLQWNSHLDKAVAQSQSF

>A0A0K0EN59_STRER/201-391

(SEQ ID NO: 346)
VPKHVQNCEHKHESGLIVTLGEDYIYGDFYHESGPHVEEQLVAAIYDL
SKYKIELYEIVIFVSKSPCFHQDCDPKCEVVDACAKLLGLLLSKVRKVDVKMTVKFL
YPHLGDLYKQGILCMLQAGIKVEPLLMKDWSAIMDWAGEYLQWNNHLDKAVAQS
QSF

>H2W477_CAEJA/255-446

(SEQ ID NO: 347)
VPKHVQNCEHKHESGLIVTLGEDYVYGDFYHESGPHVEEQLVAAIYDLSKYTVDLH
EIQIFVSKSPCFHQDCEPKCEVVDACAKLLGLLLSKVRKVDVKMTVKFLYPHLGDLY
KQGILCMLQAGIKVEPLLMKDWCAIMDWSGDYLQWNNHLDKAVAQSQLFI

>A0A0K0DCY3_ANGCA/157-328

(SEQ ID NO: 348)
IPKHVQNCDHKHESGLIVSLGDDYIYGDFYHESGPHVEEQLVANIYDLSRYKVDLHEI
VIFVSKSPCFHQDCDPKCEVVDACAKLLGLLLSKIRKVDVKMTVKFLYTHLGDLYK
QGILCMLQAGIKVGFFSVLQKAVAQSQLFIN

>A0A158PLA6_ANGCS/132-323

(SEQ ID NO: 349)
IPKHVQNCDHKHESGLIVSLGDDYVYGDFYHESGPHVEEQLVANIYDLSRYKVDLHE
VVIFVSKSPCFHQDCDPKCEVVDACAKLLGLLLSKIRKVDVKMTVKFLYTHLGDLY
KQGILCMLQAGIKVEPLLMKDWCAIMDWSGDYLQWNNHLDKAVAQSQLFI

>U6NTW9_HAECO/157-347

(SEQ ID NO: 350)
VPKHVQNCDHKHESGLIVSLGENYIYGDFYHESGPHVEEQLVANIYDLTKYNVELHE
IVIFVSKSPCFHQDCDPKCEVVDACAKLLGLLLSKVRKVDVKMTVKFLYPHLGDLY
KQGILCMLQAGIKVEPLLMKDWCAIMDWSGDYLQWNNHLDKAVAQSQLFI

>A0A158R0Z7_NIPBR/52-302

(SEQ ID NO: 351)
FSVPKHVQNCDHKHESEDYIYGDFYHESGPHVEEQLVANIYDLTKYNVELHEIVIFVS
KSPCFHQDCEPKCEVVDACAKLLGLLLSKVRKVDVKMTVKFLYPHLGDLYKQGILC
MLQAGIKVEPLLMKDWCAIMDWSGDYLQWNNHLDKAVAQSQLFI

>A0A0C2D4B7_9BILA/130-292

-continued (SEQ ID NO: 352)
VPKHVQNCDHKHESGLIVSLGEDYIYGDFYHESGPHVEEQLVANIYDLSKYNVELHE
IAIFVSKSPCFHQDCDPKCEVVDACAKLLGLLLSKVRKVDVKMTVKFLYPHLGDLY
KQGILCMLQAGIKVCGHFFVCFAYLFV

>A0A183IMD0_9BILA/141-363

(SEQ ID NO: 353)
FAVTKNTKQCGQKNETAAIVTLGGGNIEFHHESSLHPEEQLFTALMELSEYQVNLEE
VVLYCSKSPCYHQDCNPLCEVIDACAKLLVLLLYKVRTVDVNLTVRFLYPHLGDLY
KQAIMYMLQHGINVEPLLMSDWSAIVEWGCNYLDWNEHLDQAVARGQS

>A0A0N5DEG0_TRIMR/83-275

(SEQ ID NO: 354)
FLVSRSTQQCEHKHESAIVVTLGEDYVYIEYAHESGLHCEEQLMNALEELAMYTVNL
YEVVVYTSRSPCFHQNCEPRCAVIDACSKLLSLFLLKLRRVDLRMTVRFLFPHLGDL
YKQGILCMLQHGIKVEPLLMKDWSAIMDWSGDYLAWNQYLDHAVAKSQSF

>A0A085LQT5_9BILA/165-355

(SEQ ID NO: 355)
ISRTTQHCEHKHESAIVVTLGEDYVYVEYLHESSLHCEEQLLYALEELAKYAINLYEV
LVYTSRSPCFHQNCEPRCAVIDACSMLLSLFLFKLRRVDLRMTVRFLFPHLGDLYKQ
GILCMLQHGIKVEPLLMKDWSGIMDWAGDYLTWNQHLDQAVAKSQSF

>A0A077ZDL7_TRITR/175-365

(SEQ ID NO: 356)
VSRTTQHCEHKHESATVVTLGEDYVYVEYLHESSPHCEEQLLFALEELAKYAINLYEI
LVYTSRSPCFHQNCEPRCAVIDACSMLLSLFLFKLRRVDLRLTVRFLFPHLGDLYKQG
ILCMLQHGIKVEPLLMKDWSGIMDWAGDYLAWNQHLDQAVAKSQSF

>E5SVP6_TRISP/124-300

(SEQ ID NO: 357)
SRQGQQCEQKHESVILVTLGEDYVYVEFCHESSRHCEEQLAIALHELVNRSPCFHQD
CEPRCDVIDACSKLLALLLTKVRKADIRMTVRFLFPHLGDLYKQGILCMLQHGIKVE
PLLMRDWSAIMDWAGDYLGWNEHLDQAVAKSQSF

>A0A0VIMU51_9BILA/171-360

(SEQ ID NO: 358)
SRQGQQCEQKHESVILVTLGEDYVYVEFCHESNRHCEEQLAIALHELVKYKINLYEIL
IYSSRSPCFHQDCEPRCDVIDACSKLLALLLTKVRKADIRMTVRFLFPHLGDLYKQGI
LCMLQHGIKVEPLLMRDWSAIMDWAGDYLGWNEHLDQAVAKSQSF

>A0A067QK96_ZOONE/50-213

(SEQ ID NO: 359)
WTAFYINGRPKLKKCITLCHVVFNETATAEQWEISYSHGPHAEIKVLRNIKARELCLG
YTRIVTLFLSYSPCANCANFIIEFSRTRPQCTVYIRFTCLFRHPEEIHRDGLRRLNAPGIS
LGVFTVYEWRRLAEAGMPFRPWDSKWK

>H3B7Z9_LATCH/181-343

(SEQ ID NO: 360)
FYGKFNNTRKNGRNMLCFSLEGENKPWKWGYAHNSKHAENIVLREVASYKPFLNH
FYISYGPCSNCCDKILDFLQKFEKIKIMIKISRLYKDESSVFQNSIKKLHQMGVSVQVM
NRGDFEQCFKGFVQGDFQPWPALEPTSEKCAANLEA

>H3B7Z9_LATCH/4-168

(SEQ ID NO: 361)
FEAEFNNTVNSFRTLLCFSLQQENKTWNWGYAHNNDSHAEILVLREIEKYEKADHEI
RQRVTLYVTCSPCNRCCTKILEFFQRFQRFDMDIKISKIYDLDSLQDLKQLGVSLKVM
DSSDFKECFDLFVHTAEFEPWPGLEEKTKQLNAVFL

>W5M7A0_LEPOC/25-192

(SEQ ID NO: 362)
FYQEFCNTLRTCRTLLCFSLCQSTKIWDWGYAYNKGSHAESMVLEEIKTFQNQDKTL
KYTLTLYMSFSPCNECCYRLATYAKLERRIKINVMFSKLYFPEHRKIQKGLQYLECA
GVSLKVMEKQDFVTCFYLFVTEHAFQEWHCLDDMTKQYSSTLQA

>G1KV46_ANOCA/8-175

(SEQ ID NO: 363)
FEENFNNTVLVRKTLILFSFKKRSSIWKWGYAYNDGQHAECLVLSNIEQFENQIKGK
YKMTFFMSHTPCHKCSDKIVSFLASRKGLSMKIKASRPYFLNEGRKGLYLLKRIGVL
LKMMDRTDFEECFYLFVHPLTFTPWSDLDEQSKKNMDDLAA

>G3VS78_SARHA/14-179

(SEQ ID NO: 364)
FYEHFCNIKTPHQTLLCFSLKEDDKTWKWGHAYNNGYHAEILVLREIEDYANILNAT
KYTITWFLSYSPCHCCCDEITNFLMKFQKIEFNIKAARPYYFDNDKNQKGLKILKKLG
VLIKMMDFTDYEECLYLFVDPCKFTAWPDLEVQSIANKMIFHH

>K7E403_MONDO/13-175

-continued (SEQ ID NO: 365)
FHRNFSSTKASHQTLLCFGLKEEDKTWKWGHAYNNGCHAEILVLREIENYTNIPNAA
KYNITWFLSYSPCHSCCDKIINFFMNSQKIEFNIKAAKPYQFSNDQNPKGIKMLNKLGI
LFKMMEYSDFEECFYLFVDPCKFTAWPDLEAQSIANIT

>A0A091G380_9AVES/2-125

(SEQ ID NO: 366)
LFEAGGYLDAVTCENIRCIILYSSYSPCNEVPHCCVSKIYNFSLKYPEITLCIYFSQLYH
TQCPSAREALRSLWSPRVTLQRPPGELWPSFVCGGSLSHPLRTS

>A0A091WIF8_OPIHO/3-124

(SEQ ID NO: 367)
FEVGGYLDAVVYKNIRCIILYANYSPCNEAYHCCISKIYNFLLKYPEITLCIYFSRLYH
TEFPTAQEALRSLSSPRVTLQRLPAGTQHYFVYGGPLYHPSRTL

>A0A099ZXL0_CHAVO/4-126

(SEQ ID NO: 368)
EVGGYLDTVVYENIRCIIVYSNYSPCNEAYHCCVSKIYNFLLRYPEITLCIYFSKLYHT
EFPTSREALRSLSSPQVTLQRLPGGAWHYFVYGGSLYHPSRTL

>A0A091KLV2_9GRUI/4-128

(SEQ ID NO: 369)
EVGGYLDAVAYENIRWIILYSNYSPCNEAHHCCVSKIYNFLLKYPEIRLCIYFSQLYHT
EFPTAREALRSLSSPRVILQRLPGGMWHYFVYGGSLYHLSRTLQQ

>A0A093ITV6_FULGA/4-127

(SEQ ID NO: 370)
EVGGYLDAVAYENIRCIILYSNYSPCNEAYHYCISKIYNFLLKYPEITLCIYFSQFYHTE
FPTAREALRSLSSPRVTLQRLPGGARRYFVYGGALYHPSRTLR

>A0A087QVF4_APTFO/2-125

(SEQ ID NO: 371)
LFEMGGYLDAVAYENIRRIILYSTYSPCNEAYHCCISKIYNFLLKYPEITLCIYFSQLYH
TESPTAREALRSLSSPRVTLQRLPAGAQRYFVYGGSLYHPSRTL

>A0A091LC91_CATAU/4-127

(SEQ ID NO: 372)
EVGGYLDAVAYENMGCIILYSNYSPCNEAYHCCVSKIYNFLLKYPEITLCIYFSQLYH
TEFPTAREALRSLSSPRVTLQRLPGGAWRYFVYGGSLYHPSRTLR

>A0A091UXX9_PHALP/7-125

(SEQ ID NO: 373)
GYLDAVACENIGCIILYSNYSPCNEAHHFCISKIYNFLLKYPEIALCIYFSQLYHTEFPS
AREALRSLSSPRVTLQRLPGGTWRYFVYGGSLYHPPRTL

>E1BTD6_CHICK/49-244

(SEQ ID NO: 374)
RAFGFPCRAPQTHHLLFYELKSFSGTVVQKGHATSEDNHPESMLFEADGYLDAVAY
RNIGCITLYSNYSPCNEAYHCCVSKIYNFLLKYPEITLCLYFSQPYHTEFPTARQALHS
LASPQVTLQPLPTGTWCHFVYGGSLQHPPGTLRQNPHQINNFRG

>G3UV61_MELGA/48-245

(SEQ ID NO: 375)
LRAFGFPCRAAQTHHLLFYELRSFSGTVVQKGHASSEDSHPESMLFEADGYLDAVA
YGNTGCITLYSNYSPCNEAYHCCISKIYNFLLKHPETTLCLYFSQPYHIEFPTARQALR
SLASPWVTLQPLPMGTRCHFVYGGSLQHPPGTVGQNPHQINNLRG

>A0A093DVS1_9AVES/2-85

(SEQ ID NO: 376)
LFEVGSYLDAVAHENVGCIILYSNFLPCNEAYHCCISNIYNFLLKYPEITLCIYFSQLYH
TQFCATRKALQSESSEN

>A0A091Q6M3_LEPDC/5-125

(SEQ ID NO: 377)
VGGYLDAVAYGNIGCIILYSNYSPCNEAYHCCISKIYNFLLKYQEIILRIYFSQLYHTEF
PTACRALWSLSSPRVTLQRLPGGAWHYFVHGGSFYHPSRTL

>A0A093HKT8_STRCA/2-124

(SEQ ID NO: 378)
LFEAGGYLDSVTYESIGHIILYSNYSPCNEADHCCISKIYNFLIKHPEVTLCIYFSQLYH
TEFPTAREALRSLSSPHVTLYPLSGGIRHYFVYGRSLYHPSRTL

>A0A099Z1L5_TINGU/2-122

(SEQ ID NO: 379)
LFEAGGYLDAVTYEDIGYIILYSNYSPCNEADHCCLSKIYSFLTKYPQVTLCIYFSKLY
HIELPTAHEVLKSLSSPHVTLHPLCGGIWHYFVHGGSLYHPSR

>H9GLZ8_ANOCA/51-241

-continued (SEQ ID NO: 380)
FHQAFGFPYTHQNKHLLFYEVRHFSGKLMQKGHATNEDIHPESMLFETGGYLDSIN
WENVMYIILYSNYSPCNEAEQCCISKIYHFLMKYPGITLCIYFSQLYHTELPISCEALQS
LASPQVTLNPLCGGLWHSFVTSQACYHPIRALRQNAQQINNITG

>M7B925_CHEMY/46-257

(SEQ ID NO: 381)
FHKAFGFPYMPQNKHLIFYELRSFSGTLVQKGHATNKNIHPESMLFEMGGYLDALD
YDSIRYIILYSNYSPCNEAEHCCISKIYNFLTKYPDITLCIYFSQLYHMEFPVSCEALRS
LASPHVTLNPLCGGVWHSFVSGEALYHPARALQQNSYKINNITG

>H3B3J0_LATCH/47-227

(SEQ ID NO: 382)
FYEAFGFPYTPRNKHLLFYELRNISGTLIQKGQATNLNLHPESTLFDLDGYLDSIIYDN
ISYITLYSNYSPCNESNHYCIGKMYDFLISYPSTRLDIYFSQLYHTDFPESREALRSLAG
PRVTISPISGGTWLSFVNGQALYNPTRAFKHNAY

>F6ZR34_XENTR/47-234

(SEQ ID NO: 383)
FYEAFGFPYTPENKQLIFYEVKDFSGTNIQKGQVTNSNIHAESILFEDSGYLDALHHGS
VGYITLYANYTPCNEYGHYCISKMYNFLLKYEDTRLDIYFSQLYHVESPAARQALRS
LASPRVTVNPLSEGIWQTFAKGLSFYEPARASSSNASTIHLITG

>F6VU78_ORNAN/48-231

(SEQ ID NO: 384)
FYQTFGFPHMPQPEHLTFYELKTFSGAPVQKGQATSQSIHPESMLFEEGGYLDSVYD
DSIGHIILFSNYTPCNEAGHCCISQMFDFLMTYPDITLSIYFSQLYHTEFPASRKALRSL
ASPRVSVNPISGGIWHAFVSGGALRHPSRALGHNAYEINA

>G3WLB3_SARHA/47-227

(SEQ ID NO: 385)
FYQIFGFPYSPQTQHLTFYELKTSSGSLVQKGHASGEDTHPESMLFEMDSYLEAVNN
DNIEHVFLYSNYCPCNEANHCCISKMYNFLMRYPAISLNIYFSQLYHTEFPVSREALR
SLASPQVTVNPMSGGIWHYFVSDEALHQPARTLRHNAYE

>H0VBH8_CAVPO/47-214

(SEQ ID NO: 386)
FHQIFRFPYTPSTKHLTFYELKTFSGSLVQKGHASNGHTHPESMLFEMNGYLDSANN
SSIKHIILYSNNSPCNEANHCCISKMYNFLTMYPDVTLSVYFSHLYHTGFPASREALRS
LASPQVTLSPISGGIWHCFVTGGAAFQP

>G5B4444_HETGA/47-231

(SEQ ID NO: 387)
TKHLTFYELKTSSGTLVQKGHASNGDTHPESMLFEMNGYLDSASN
STIKHIILYLNNFPCNEANHCCISKMYNFLMMYPDITLSIYFSQLYHTKFPTSREALRS
LASPQVTLSPISGMIWHSFVMGGPAFQPGRALRHNAYE

>ABEC4_MOUSE/47-263

(SEQ ID NO: 388)
FHQTFGFPWTPQTKHLTFYELRSSSKNLIQKGLASNGHNHPEAMLFEKNGYLDAVH
NSNIRHIILYSNNSPCNEAKHCCISKMYNFLMNYPEVTLSVFFSQLYHTEFPTSRKALQ
SLASPQVTLSPICGGLWHAFVSNGSVPQPGRILRYNTYEINSIIA

>ABEC4_RAT/47-256

(SEQ ID NO: 389)
FHQTFGFPWTPQTKHLTFYELRSSSGNLIQKGLASNGHTHPESMLFERDGYLDSLHD
SNIRHIILYSNNSPCDEANHCCISKMYNFLMNYPEVTLSVFFSQLYHTEFPTSREALRG
LASPQVTLSAISGGIWQSFVSGGLAVRPGRTLRYNAYEINCITE

>F7D911_HORSE/47-232

(SEQ ID NO: 390)
FYQIFGFPYMPQTKHLTFYELKTTSGSLVQKGHASSGNTHPESMLFELNGYFDSANN
DSIRHIILYSNNSPCNEANHCCISKMYNFLIMYPHVTLSIYFSQLYHTEFPASREALRSL
ASPQVTLSPISGGIWHSFVSGGPVFQPGRALRHNAYEINAI

>GINXW1_MYOLU/47-231

(SEQ ID NO: 391)
FYQIFGFPYTPQTKHLTFYELKTSTGGLVQKGHASSTSTHPESMLFETNGYFDWANN
GGIRHIILYSNHSPCNEADHCCISKMYNFLTTYPDVTLSIYFSQLYHTDFPASREALRS
LASPKVTLSPISGGIWHFFVSGGSVFQPGRALRHNAYEINA

>F1S657_PIG/47-239

(SEQ ID NO: 392)
FYQLFGFPYTPQTKHLAFYELRPSSGSLVQKGHASSGDTHPESMLFERNGYFDSANN
NGIRHIILYSNNSPCNEANHCCISKMYNFLRMYPDVTLSIYFSQLYHTEFPASREALRS
LASPQVTLSPISGGIWHSFVSGGWLFQPGRALRHNAYEINAITG

>S9WFU5_CAMFR/54-199

-continued (SEQ ID NO: 393)
FYQLFGFPYVPQTKHLTFYELKTSPGSLVQKGHENSGDTHAESMLSEMNGYFDSAN
HQGIRHIILYSNNSPCDEANHCCTSKMYNFLTMYPDVTLSIYFSQLYHTEFPASREAL
RSLASPQVTVSPP

>H0WM53_OTOGA/47-232

(SEQ ID NO: 394)
FYQIFGFPYISQTKHLTFYELKTSSGSLVQKGHASRGDTHPESMLFEMNGYLDSANN
DGIRHIILYSSNSPCNEANHCCISKMYNFLKVYPDVTLSVYFSQLYHTEFPASREALRS
LASPQVTLSPISGGIWHSFVSGGSVFQPGRALRQNAYEINAI

>G3MWJ4_BOVIN/47-233

(SEQ ID NO: 395)
FYQIFGFPYTPPTKHLTFYELKTSSGSLVQKGHASSGDTHPESMLFEVNGYFDSANND
CIRHIILYSSNSPCNEANHCCISKMYTFLAKYPDITLSVYFSQLYHTEFPASREALRSLA
SPQVTLSPISGGIWYSFVSGGAVFQPGRALRHNAHEINAIT

>W5P5G7_SHEEP/47-235

(SEQ ID NO: 396)
FYQIFGFPYTPPTKHLTFYELKTSSGSLVQKGHASSGDTHPESMLFEMNGYFDSASND
GMRHIILYSSNSPCNEANHCCISKMYTFLAKYPDITLSIYFSQLYHTEFPASREALRSL
ASPRVTLSPISGGMWYSFVSGGAVFQPGRALRHNAHEINAITG

>G1L6U8_AILME/47-234

(SEQ ID NO: 397)
FYQIFGFPYTPQTKHLTFYELKTSSGSLVQKGHASSGNTHPESMLFEMNGYFDSANN
NAIRHIILYSNNSPCNEANHCCISKMYNFLILYPDITLSIYFSQLYHTEFPASREALRSL
ASPQVTLSPISGGMWHSFVSGGSVFQPGRALRHNAYEINAITG

>M3YK05_MUSPF/47-239

(SEQ ID NO: 398)
FHQIFGFPYVPQTKHLTFYELKTSSGSLVQKGHASSENTHPESMLFEMNGYFDAAKN
NAIRHIILYSNNSPCNEANHCCISKMYNFLIMYPDVTLSIYFSQLYHTEFPASREALRS
LASPQVTLSPISGGIWHSFVSGGPVFQPRRALRHNAYEINRITG

>M3WE63_FELCA/47-233

(SEQ ID NO: 399)
FYQIFGFPYAPQTKHLTFYELKTSSGSLVQKGHASSGNTHPESMLFEMNGYLDSANN
NAIRHIILYSSNSPCNEADHCCISKMYNFLIMYPDVTLSIYFSQLYHTEFPASREALRSL
ASPQVILSPISGSIWHSFVSGGSVFPPGRAQRHNAYEINAIT

>E2RD46_CANLF/47-236

(SEQ ID NO: 400)
FYQIFGFPYVPQTKHLTFYELKTSSGSLVQKGHASSGNTHPESMLFEMNGYFDSANN
NTIRHIILYSNNSPCNEANHCCIGKMYNFLITYPDVTLSIYFSQLYHTEFPASREALRSL
ASPRVTLSPISGGIWYSFVSGGSVFQPGRALRHNAYEINAITG

>L9L463_TUPCH/47-264

(SEQ ID NO: 401)
FYQIFGFPYTPQTKHLTFYELKTSSGSLVQKGHASSGQIHPESMLFEMNGYLDLANN
GGIRHIVLYSNHSPCNEAHHCCISKMYNFLITHPDITLSIYFSQLYHTEFPTSREALRSL
ASPRVTLSPISGGIWHSFVSGGSVFQPGRALRHNAYEINAITG

>A0A0D9SA64_CHLSB/47-231

(SEQ ID NO: 402)
FCQIFGFPYTPQTKHLTFYELKTSSGNLVQKGHASSGYIHPESMLFEMNGYLDSANN
DNIRHIILYCNNSPCNEANHCCISKVYNFLITYPGITLSIYFSQLYHTEFPASREALRSL
ASPRVVLSPISRGIWHSFVSGGSVFQPGRALRHNAYEINA

>F7GWZ1_CALJA/47-228

(SEQ ID NO: 403)
FCQIFGFPYTHQTKHFTFYELKTPSGSLVQKGHASSGYIHPESMLFEMNGYLDSASND
SIRHIILYSSNSPCNEANHCCISKMYNFLITYPGVTLSIYFSQLYHTEFPASREALRSLAS
PQVILSPISGGIWHSFVSGGSVFQPRRALRHNAYE

>H2N4F1_PONAB/47-228

(SEQ ID NO: 404)
FCQIFGFPYAPQTKHLTFYEVKTSSGSLVQKGHASSGDIHPESMLFEMNGYLDSANN
DSIRHIILYSSNSPCNEANHCCISKMYNFLITYPGVTLSIYFSQLYHTEFPASREALRSL
ASPRVVLSPISGGIWHSFISGGSIFQPGRALRHNAYE

>G3R253_GORGO/47-228

(SEQ ID NO: 405)
FCQIFGFPYTPQTKHLTFYELKTSSGSLVQKGHASSGYIHPESMLFEMNGYLDSANND
SIRHIILYSNNSPCNEANHCCISKMYNFLITYPGITLSIYFSQLYHTEFPASREALRSLAS
PRVVLSPISGGIWHSFISGGSVFQPGRALRHNAYE

>K7G199_PELSI/28-181

-continued (SEQ ID NO: 406)
DPSVLRRVQYLLYEVKWSNSRKLTQCCHSTRTEHAEIYFLEDVFHRQRYDPSDHCSL
TWYMSWSPCGECCKAIRDFLKEQPNVNLVIYVARIYCHEEENNRQGLRSLVNIVTIRI
MDLPVYSYCWRTFVCDEDKDEDYWPRHFAPWIMLYS

>K7G211_PELSI/1-118

(SEQ ID NO: 407)
HAEIYFLKDVFNRQRNDPSDHCSLTWYMTWSPCGECCKAIRDFLKEQPNVNLVIYV
ARIYCHEEENNRQGLRSLVNIVTIRIMDLPVYSYCWRTFVCDEDNFPGSPEGSHHKS
MLLT

>A0A09318Y9_STRCA/1-74

(SEQ ID NO: 408)
ITLYLSWSPCRNCCYEMQYFLKKHPNVNICIYLARLYYTEDEEICKALKDLSEKVIISV
MKIEDYIYCWKTFV

>A0A091MHU6_9PASS/1-63

(SEQ ID NO: 409)
ITWYLSWSPCVNCCYKIRDFLNRHSYVTIRIYVARLCYRGFHRNRKGLRNLVSLRVT
VNVME

>A0A093S6Z3_9PASS/1-65

(SEQ ID NO: 410)
ITWYLSWSPCVNCCNEILDFLERHENVNIDIHVARLYFKDSKRTHRALKELARSTVSI
NVMNME

>R4GDA3_ANOCA/18-173

(SEQ ID NO: 411)
QRNFDPREFPECTLLLYEIHWDNNTSRNWCTNKGLHAEENFLQIFNEKIDIRQDTPCSI
TWFLSWSPCYPCSQAIIKFLEAHPNVSLEIKAARLYMHQIDCNKEGLRNLGRNRVSIM
NLPDYRHCWTTFVVPRNEDYWPQDFLATNYSREL

>A0A091ETZ4_CORBR/1-64

(SEQ ID NO: 412)
ITWYLSWSPCMTCCYIIRNFLVRHPNVNIEIHVARLYNTRWAGTRRGLRELARLRVTI
DVME

>U3JXR8_FICAL/12-171

(SEQ ID NO: 413)
FDPRTYPSETYLLCELQWGGSGRFWIHWARNDEDSHVEHYFLEQIFEPRSYSVCDIT
WYLSWSPCANCCDIIQEFLEEQHNVNLDIRVARVYNEHIRENRAALRQLANFQAAIR
AMDVEDYMYCWDTFLQQGGYFDFTAGSFRSAVERTRLRLE

>H0ZSB5_TAEGU/1-76

(SEQ ID NO: 414)
DMTWYLSWSPCGECCDIIQDFLEEQPNVNINIRVARLYYTDRASNRKGLRELASSPV
TLEIMDAEDYNYCWETFI

>A0A091R868_9GRUI/1-65

(SEQ ID NO: 415)
ITWYLSWSPCANCCYEIVDFLQRHSYVNIKIFVARLYYIDRERNRQGLRDLMNSAVTI
DVMDIE

>A0A091QH63_MERNU/1-65

(SEQ ID NO: 416)
ITWYLSWSPCANCCYRIVQFLMKHSYVSIDIRVARLYFIEDETTRQGLEELVSCAVRL
TVMDTE

>A0A091IKM1_CALAN/1-70

(SEQ ID NO: 417)
ITWYLSWSPCACCCCKIQDFLKMNSYVNTDIDVAQLYGNYQEQNCQGLKNLKSLAV
TIAVMRIEDKISC

>A0A094K7N8_ANTCR/1-65

(SEQ ID NO: 418)
ITWYLSWSPCANCCRKIRNFLKKHSYVYIDIYVARLYYIDDEENRRGLRNLQSLDVTI
AVMEIE

>A0A091GQ55_BUCRH/1-65

(SEQ ID NO: 419)
ITWYLSWSPCADCCCKIVNFLKKHSYVNMRIYVARLYYPEYETNRRGLKNLRNLAV
PIAVMEIE

>A0A151P7C9_ALLMI/18-177

(SEQ ID NO: 420)
FEKNYKPIDGTKEAHLLCEIKWGKYGKPWLHWCQNQRNIHAEDYFMNNIFKAKKH
PVHCYVTWYLSWSPCADCASKIVKFLEERPYLKLTIYVAQLYYHTEEENRKGLRLLR
SKKVIIRVMDISDYNYCWKVFVSNQNGNEDYWPLQFDPWVKENYSRL

>A0A093CT04_TAUER/1-65

-continued (SEQ ID NO: 421)
ITWYLSWSPCARCCYKILDFLKEHSYVNLHIYVARLYCIEDEKTRRGLKKLNSLEVTI
AVMEEE

>A0A091V1W3_PHORB/1-65

(SEQ ID NO: 422)
ITWYLSWSPCAKCCYEILNFLKKHPNVNIDIYVARLYDIEKEKTRQGLKNLVRLPVTI
AVMEME

>A0A091V9F4_NIPNI/1-65

(SEQ ID NO: 423)
ITWYLSRSPCAKCCYEILDFLNKHSNVNIDIYIAQLYKIKNEENCQGLRNLVSLAVTIA
VMEIE

>A0A151P6H5_ALLMI/36-174

(SEQ ID NO: 424)
SELTWGGRPYKHWYENTEHCHAEIHFLENFSSKNGSCIITWYLSWSPCAECSARIADF
MKENTNVKLNIHVARLYLHDDKHTRQGLRYLMKMKVTIQIMTIPDYKYCWNTFLE
DDGEDESDDYGGYAGVHEDEDESD

>A0A099ZZR5_CHAVO/1-65

(SEQ ID NO: 425)
ITWYLSWSPCAECCLKILNFLEENSNVNIDIHIARLYRIQDERNRQGLRELVSSEVTIA
VMGIE

>A0A093J615_FULGA/1-65

(SEQ ID NO: 426)
ITWYLSWSPCAKCCRKILNFLKMHSNVKIDIYVARLYYIEDEKNRQGLKKLVSLAVK
IAVMEIE

>A0A091PTE0_LEPDC/1-75

(SEQ ID NO: 427)
VTWYLSWSPCVNCCRKILNFLKKHSNVNIDMHVARLYYIEDERIRQGLKNLVSLAVT
IAVMEIEDYTYCWKNFI

>A0A093JP51_EURHL/1-65

(SEQ ID NO: 428)
ITWYLSWSPCAHCCRKILNFLKRHSDVNIHIYIARLYYIENEEIRQGLKNLVSLEVKIA
VMETE

>A0A091RWG2_NESNO/1-65

(SEQ ID NO: 429)
ITWYLSWSPCVNCCRKILKFLKQHSYVNIKIYVARLYYIDDDEIRQNLKNLVSLVVTI
AVMDIE

>A0A0Q3WRD0_AMAAE/72-248

(SEQ ID NO: 430)
LKYHFDPREVXRDTYLLCILRWGETGTPWSHWVKNRYHAEVYFLEKIFQTRKSSKNI
NCSITWYLSWSPCAKCCRKILNFLKKHSYVSIKIHVARLFRIDDKETXQNLKNLGSLV
VTVSVMEXEDYTNCWKTFIRGHADGDSWIDDLKSEIRKNRLKFQ

>A0A091PR75_HALAL/1-65

(SEQ ID NO: 431)
ITWYLSWSPCADCCHKILKFLKKHSNVNIDIHVARVYYAEDEKVRQGLKNLVSLAV
TIAVMETK

>A0A087QNJ4_APTFO/1-65

(SEQ ID NO: 432)
ITWYLSWSPCADCCRKILNFLKKNSNVNIDIYVARLYYTEDEKIRQGLQNLVSLAVTI
AVMETE

>A0A087VRL2_BALRE/1-66

(SEQ ID NO: 433)
ITWYLSWSPCADCCHKILNFLKRHSNVNIDIYVARLYYIEDEEIRQCLKNLVSLAVTIA
VMKIE

>A0A093F6R6_GAVST/1-69

(SEQ ID NO: 434)
ITWYLSWSPCANCCRKILRFLRKHSNVNIDIHVARLYYIEDENIRQGLKSLVNLAVTI
AVMEIEGKVF

>A0A091TH63_PHALP/1-65

(SEQ ID NO: 435)
ITWYLSWSPCADCCHKILNFLKKHSNVNIIIYVARLYYKEDEKIRQGLKNLVNLAITIA
VMEIE

>A0A093QYH8_PHACA/1-65

(SEQ ID NO: 436)
ITWYLSWSPCEECCCKILNFLKKHSNVSICIYVARLYHIEDEKIRQGLKNLVNFTVTV
AVMGIE

>Clipboard_Contents
(SEQ ID NO: 437)
FEVFFDPRELRKETCLLYEINWGGRHSIWRHTSQNTNKHVEVNFIEKFTTERYFCPNT
RCSITWFLSWSPCGECSRAITEFLSRYPHVTLFIYIARLYHHADPRNRQGLRDLISSGV
TIQIMTEQESGYCWRNFVNYSPSNEAHWPRYPHLWVRL >L5KGJ8_PTEAL/30-187
(SEQ ID NO: 438)
FEVFFDPRELRKEACLLYEIQWGTSHKIWRNSGKNTTKHVELNFIEKFTSERHFCSSV
SCSIIWFLSWSPCWECSKAIREFLSQRPTVTLVIFVSRLFQHMDQQNRQGLRDLINSG
VTIQIMRASEYDHCWRNFVNYPPGKEAHWPRYPPLWMKLYA >L5LUG3_MYODS/37-228
(SEQ ID NO: 439)
IFDPRELRKEACLLYEIKWGTGHKIWRHSGKNTTRHVEVNFIEKITSERQFCSSTSCSII
WFLSWSPCWECSKAITEFLRQRPGVTLVIYVARLYHHMDEQNRQGLRDLVKSGVTV
QIMTTPEYDYCWRNFVNYPPGKDTHCPIYPPLLMKLYALELH >F6WR88_HORSE/9-168
(SEQ ID NO: 440)
FEAFFDPRELRKEACLLYEIKWGMSHNIWRYSGKNTTKHVEINFIEKFTSERHLRPSIS
CSIVWFLSWSPCWECSKAIREFLSQHPNVTLVIYVARLFQHMDRLNRQGLRDLINSG
VTIQIMRTSEYDHCWRNFVNYPPGKEAHWPRYSLLWMKLYALEL >F1SLW4_PIG/25-176
(SEQ ID NO: 441)
VFFDPRELRKETCLLYELQWGRSRDTWRHTGKNTTNHVERNFLAKITSERHFHPSVH
CSIVWFLSWSPCWECSEAIREFLDQHPSVTLVIYVARLFQHMDPQNRQGLRDLVNHG
VTIQIMGAPEYDYCWRNFVNYPPGKEAHWPRFPPVWMT >W5NVH9_SHEEP/27-179
(SEQ ID NO: 442)
FDPRNFCKEAYLLYEIQWGNSRDVWRHSGKNTTKHVERNFIEKIASERHFRPSISCSIS
WYLSWSPCWECSKAIREFLNQHPNVTLVIYIARLFQHMDPQNRQGLKDLFHSGVTIQ
VMRDPEYDYCWRNFVNYPQGKEAHWPRYPPLWMNLYA >M3WB96_FELCA/23-178
(SEQ ID NO: 443)
FEVFFDPRELRKEACLLYEIKWGTSHRIWRNSGRNTANHVELNFIEKFTSERHFCPSV
SCSITWFLSWSPCWECSKAIRGFLSQHPSVTLVIYVSRLFWHLDQQNRQGLRDLVNS
GVTVQIMRVPEYDHCWRNFVNYPPGEEDHWPRYPVVWMKL >F1PUJ5_CANLF/23-183
(SEQ ID NO: 444)
FEGFFDPRELRKETCLLYEIQWGTSHKTWRNSGKNTTNHVEINFMEKFAAERQYCPS
IRCSITWFLSWSPCWECSNAIRGFLSQHPSVTLVIYVARLFWHTDPQNRQGLRDLINS
GVTIQIMTVPEYDHCWRNFVNYPPGKEDHWPRYPVLWMKLYALELH >I3N301_ICTTR/12-175
(SEQ ID NO: 445)
FEVFFNPGVLRKETCLLYEIQWGTSRKIWRNSSKNTTNHVEVNFIEKFTAERHFCPSIS
CSITWFLSWSPCWECSKAIREFLSQHPNMTLVIYTARLFQHMDQQNRQGLRDLINSG
VTIQMMTVSDSLTCWLHFLSHRVYVILMKKCGNLV >G1TVM9_RABIT/50-205
(SEQ ID NO: 446)
FEVFFDPQELRKEACLLYEIKWGASSKTWRSSGKNTTNHVEVNFLEKLTSEGRLGPS
TCCSITWFLSWSPCWECSTAIREFLSQHPGVTLVIFVARLFQHMDRRNRQGLKDLVT
SGVTVQVMSVSEYCYCWENFVNYPPGKAAQWPRYPPRW >H0VV31_CAVPO/20-179
(SEQ ID NO: 447)
FEASFDPRQLQKEACLLSEVRWGASPRTWRESGLNTTSHVEINFIEKFTSGRSLRPAIR
CSVTWFLSWSPCWECARAIREFLHQHPNVSLVIYVARLYWHVDEQNRQGLRDLVTS
GVRVQIMSDSEYSHCWRNFVNFPPGQEAGWPRFPPMWTTLYA >H0W6W5_CAVPO/16-179
(SEQ ID NO: 448)
FEAYFDPRQLRKEACMLSEVRWGASPRTWRESSLNTTSHVEINFIEKFTSGRSLRPAV
RCSMTWFLSWSPCWECARAIREFLHQHPNVSLVIYVARLYWHVDEQNRQGLRDLV
TSGVRVQIMSDSEYRHCWRNFVNFPPGQEAGWPRFPPMWTTLYA

>F7F6M6_CALJA/24-178

-continued (SEQ ID NO: 449)
YISYDPKELCKETCLLYEIKWGMSWKIWRSSGKNTTNHVEINFIEKFTSERHFHLSVS
CSITWFLSWSPCWECSQAIREFLSQHPGVTLVIYVARLFQHMDQQNRQGLRDLVNSG
VTIQMMTVSEYYHCWRNFVNYPPGEEAHWPRHPPLWLMLY

>A0A096MWB4_PAPAN/24-177

(SEQ ID NO: 450)
DIFYDPRELRKEACLLYEIKWGMSPKIWRSSGKNTTNHVEVNFIEKLTSERRFHSSISC
SITWFLSWSPCWECSQAIREFLSQHPGVTLVIYVARLFWHTDQQNRQGLRDLVNSGV
TIQIMTASEYYHCWRNFVNYPPGEEAHWPRYPPLWMML

>G1QZV0_NOMLE/24-177

(SEQ ID NO: 451)
DVFYDPRELRKEACLLYEIKWGMSQKIWRSSGKNTTNHVEVNFIKKFTSEGRFQSSIS
CSITWFLSWSPCWECSQAIREFLSQHPGVTLVIYVARLFWHMDQQNRQGLRDLVNS
GVTIQIMRASEYYHCWRNFVNYPPGDEAHWPRYPPLWMML

>H2Q5C6_PANTR/23-177

(SEQ ID NO: 452)
FDVFYDPRELRKEACLLYEIKWGMSRKIWRSSGKNTTNHVEVNFIKKFTSERHFHPSI
SCSITWFLSWSPCWECSQAIREFLSQHPGVTLVIYVARLFWHMDQQNRQGLRDLVNS
GVTIQIMRASEYYHCWRNFVNYPPGDEAHWPQYPPLWMML

>K7G211_PELSI/189-300

(SEQ ID NO: 453)
ERSLNPLTHCSVTWFLSWSPCWKCSQSVVEFRKAYPKVNLEIYVARLFRHEEECNRQ
GLRDLVMNGVTIRVMNLSAYNYCWRTFVSHQGDDYWPWHLT

>A0A151P6M4_ALLMI/21-173

(SEQ ID NO: 454)
FQENYMPSTWPKVTHLLYEIRWGKGSKVWRNWCSNTLTQHAEVNCLENAFGKLQF
NPPVPCHITWFLSWSPCCQCCRRILQFLRAHSHITLVIKAAQLFKHMDERNRQGLRDL
VQSGVHVQVMDLPDYRYCWRTFVSHPEGEGDFWPWFF

>A0A091EQ78_CORBR/9-142

(SEQ ID NO: 455)
FQINYSPSQHRRGVYLLYEIRWRRGSIWRNWCSNTHRQHAEVNFLENCFKDRPQVP
CSITWFLSASPCGKCSKRILEFLKSRPYVTLKIYAAKLFRHHDIRNREGLCNLGMHGV
TIHIMNLEDYSYCWRNFVVY

>U3JXR8_FICAL/251-385

(SEQ ID NO: 456)
FQRNYSPSQNGRVVYLLYEIRWKGGSIWRNWCSNNPEQHAEINFLENRFNDRPQTSC
SITWFLSTSPCGKCSKRILEFLRSHPNVTLKIYTAKLFRHYEIRNRQGLRNLIMNGVAV
HIMNLEDYSYCWTNFVAHQ

>H0ZSB3_TAEGU/8-142

(SEQ ID NO: 457)
FQRNYSPRQHGRVVYLLYEIRWRRGSIWRNWCLNNHEQHAEVNFLENHENDRPQTP
CSITWFLSTSPCGKCSRRILDFLRSHPNVTLVIYAAKLFKHHDIRNRQGLRNLNMNGV
TIRIMNVEDYRYCWRNFVAY

>A0A093PWR2_9PASS/7-142

(SEQ ID NO: 458)
FKRNYLPGQHPQVVYLLYEIRWRNGSIWRNWFSNNRNQHAEVNFLENCFSDVPPAP
CSITWFLSTSPCGKCSRRILEFLRTHRNVTLEIYAAKLFRHQDIRNRQGLCNLVMNGV
TIHIMNLADYSYCWKRFVAY

>A0A091MEP8_9PASS/7-142

(SEQ ID NO: 459)
FQRNYLPDQHPQAVYLLYEFRWRRGSIWRKWCSNNRAQHAEVNFLENCFNGIPPVP
CSITWFLSTTPCGNCSRRILEFLRLHPNVTLEIYAAKLFRHTDIRNRKGLYNLAMNGVI
IRIMNLADYSYCWRNFVAY

>A0A091RF60_9GRUI/11-129

(SEQ ID NO: 460)
RNYLPGCYPKVVYLLYEIKWRRGTTWRNWCSNSRNLHAEVNFLENCFKAVPSVSCS
MTWFLSAIPCGKCSRRILEFLKVYPNVTLEIYAAKLFKHLDIRNRQGLRNLAMNGVII
RIMNL

>A0A091IIG0_CALAN/8-142

(SEQ ID NO: 461)
FKRNYQPGRRPNVVYLLYEIRWRRGTIWRNWCSNEFPQHAEDNFFQNRFNAVPSVS
CSITWFLSTTPCGRCSKRILEFLRLHPNVTLKIYAARLFRHLDNRNRQGLRKLASNGV
IIQIMGLPDYSYSWKKFVAY

>A0A091QEK6_MERNU/8-142

```
                                              (SEQ ID NO: 462)
FKTNYSPDHRPRVVYLLYEIRWRRGTIWRNWCSNNIDQHAEVNFLENCFKAKPSVS
CSITWFLSTAPCAKCSRRILKFLTAHPKVTLEIYAAKLFRHLEIRNRQGLMDLAVNGV
ILRIMNLADYSYCWKQFVAY

>A0A093GVH6_PICPB/10-142
                                              (SEQ ID NO: 463)
KLNYVPVGRPRVVYLLYEIRWSRGSIWRNWCSNSSTQHAEVNFLENCFKAMPSVSC
SITWFLSTTPCGNCSRRILEFLRAHPKVTLAIHAAKLFKHLDVRNRHGLKALATDGV
VLHIMSIADYRYCWTKFVAY

>A0A091PSV3_HALAL/7-142
                                              (SEQ ID NO: 464)
FKRNYLPGQHPKVVYLLYEIRWSRGTIWRNWCSNNSTQHAEVNFLENCFKATPSVS
CSITWVLSTTPCGKCSRRILEFLRVHPNVTLEIYAAKLFKHLDIRNRKGLRDLAMNGV
IIRIMNLSDYSYCWKTFVAY

>A0A091M4D7_CARIC/8-142
                                              (SEQ ID NO: 465)
FKRNYLPGQHPEVVYLLYEIKWNSGTIWRNWCSNNPTQHAEVNFLENHFNVMSSVS
CSITWGISTTPCGKCSRRILEFLTTHPNVTLEIYAAKLFKHLDIRNRQGLRNLAMNGV
VICIMNLADYSYFWKTFVAY

>A0A099ZZX4_CHAVO/10-142
                                              (SEQ ID NO: 466)
IRNYLPDKHPNVVYLLYEIRWSRGTIWRNWCSNNSTQHAEVNFLENCFKAMPSVSC
SITWFLSTTPCGRCSRRILKFLRVHPNVTLKIHAAKLFKHLDMRNRQGLKNLAMHGV
IIRIMNLADYSYCWKTFVAH

>A0A094MFH1_ANTCR/11-142
                                              (SEQ ID NO: 467)
RNYLPVQYPNMVYLLYEIRWSTGTIWRNWCSNNSTQHAEVNFLENRFNSRPSVSCSI
TWVLSTTPCGKCSTKILEFLRLHPNVTLKIYAAKLFKHLDIRNRQGLRNLAMNGVIIRI
MNLADYSYCWKTFVAY

>A0A093FY71_TYTAL/8-142
                                              (SEQ ID NO: 468)
FKRNFLPGQHPKVVYLMYEIRWIRGTAWRSWCSNNSKQDAEVNLLENCFKAMPSV
FCSVTWVLFTTPCGKCFRRILEFLRVHSNVALERYAAQLFRHLDICNWQGIRSLAMN
GVIIHIMNLADYSYCWKRFVAY

>A0A091TCM6_PHALP/7-142
                                              (SEQ ID NO: 469)
FKRNYSPGQHPKVVYLLYEIRWSRGTTWRNWCSNNSTQHAEVNFLENCFKAMPSVF
CSITWVLSTTPCGKCSRRIQEFLRVHPNVTLEIYAAKLFKHLDRRNRQGLRNLAMNG
VIIRVMNLADYRYCWKRFVAY

>A0A093CIQ8_9AVES/5-130
                                              (SEQ ID NO: 470)
FKINNLPGQHPRVVCLLYAIRWSRSTLWKSWCSNNSTQHAEVNFLENCFKGNPSVFC
FMTWFFHTTPHGKCCRRTPEFLGVHPNVTLKIRAAKLFKHLDRYNQQGLRNVAMN
GVVIRIINL

>A0A093F3R4_GAVST/8-142
                                              (SEQ ID NO: 471)
FKRNYLPAQHPKVVYLLYEIRWSRGTIWRNWCSNNSTQHAEVNFLENCFKAMPSVS
CSITWFLSTTPCGKCSRRILTFLREHPNVTLEIYAAKLFKHLDVRNQQGLRNLDRNGV
IIRIMNFADYSYCWKRFVAY

>A0A093LP85_FULGA/9-142
                                              (SEQ ID NO: 472)
FKRNFLPSKYPKVVYLLYEIRWSSGTIWRSWCSNNSTQHAEVNFLENCFKAMPSVSC
SITWVLPITPCGKCSKKILEFLSVHPNVTLEIYAAKLFRHLDIRNQQGLRNLAMNGVII
RIMNLADYSYSWKRFVAY

>A0A091SSF0_9AVES/7-142
                                              (SEQ ID NO: 473)
FKRNYLPGQHPKVVYLLYEIRWSRGTIWRSWCSNNSKQHAEVNFLENCFKARPSVS
CSITWVLSTTPCGKCSRRILEFLRVHPNVTLEIYAAKLFKHLDIRNQQGLRNLAMNGV
IIRIMNLADYSYCWKRFVAH

>A0A093JI54_EURHL/9-142
                                              (SEQ ID NO: 474)
FKRNYMPSQYPKVVYLLYEIRWSRGTVWRNWCSNSFTQHAEVNFLE
NYFKPMPSVSCSITWVLSTTPCGKCSRRILEFLRVHPNVTLEIYAAKLFKHLDIRNRQ
GLRDLAMNGVTIRIMNLADYSFCWKRFVAY

>A0A087QNJ5_APTFO/8-142
```

-continued

>A0A093RC01_PHACA/9-142

(SEQ ID NO: 475)
FKRNYLPGQHPKVVYLLYEIRWSRGTIWRNWCSNNSTQHAEVNFLENCFKAMPSVS
CSITWVLSTTPCGKCSRRILEFLRVHPNVTLEIYAAKLFKHLDIRNRQGLRNLAMNGV
IIRIMNLADYSYGWKRFVAY

>A0A093RC01_PHACA/9-142

(SEQ ID NO: 476)
FKRNYSPCQHPKVVYLLYEIRWRGAIWRSWCSNNSTQHAEVNFLENCFRAMPSAS
CSITWVLSTSPCGKCSRRILEFLRVHPNVTLEIYAARLFKHLDTRNRQGLRNLAMEGV
VIRIMNLADYSYWWKRFVTY

>A0A091V7F8_NIPNI/10-142

(SEQ ID NO: 477)
RSNYLPCQHPRVVYLLYEIRWSRGTIWRNWCSNNSTQHAEVNFLENCFKAMPSVPC
SITWVLSTTPCGKCSRRILEFLRVHPNVTLEIYAAKLFKHLDIRNRQGLRNLAKNGVV
IRIMKLADYSYWWKRFVAY

>A0A091XJL0_OPIHO/7-142

(SEQ ID NO: 478)
FKRNYLPGQHPKVVYILYEIRWSRGTIWRNWCTNNSTQHAEVNFLENCFKAMPSVS
CSITWVLSTTPCGKCSKRIQDFLRIYPNVTLEIHAAKLFKHLDTRNREGLRNLAKDGV
IIHIMNLADYSYWWKRFVAY

>A0A091RU17_NESNO/8-142

(SEQ ID NO: 479)
FKRNYLPYQHPKVVCLLYEIRWNRGTIWRSWCSNNSTQHAEVNFLENCFKAKPSVS
CSITWVLSTTPCGECSRRILDFLSVYPNVTLKIYAAKLFKHLDNRNRQGLWNLANNR
VIIRIMNLEDYNYYWKRFVAY

>A0A0Q3WQU9_AMAAE/56-187

(SEQ ID NO: 480)
FKRNYLPNRHPKVVCLLYEIRWSRGTIWRNWCSNSSTQHAEVNFLENCFKANPSVSC
SITWVLSTTPCGKCSRRILDFLSGYPNVTLEIYAAKLFKHLDNRNRQGLWNLANNRV
SIHIMNLAGSGKLLV

>A0A094LEL8_9AVES/8-141

(SEQ ID NO: 481)
FKGNYLPDKHPRVVYLLYEIRWSRGTIWRNWCSNSSTQHAEINFLENCFKTSKTVSC
SIIWVLSTTPCGKCSRRILEFLREHPNVTLEIHAAKLFKHLDTRNQQGLRDLAMKGVII
HIMNVADYSYWWKRFVA

>A0A087VMP5_BALRE/8-142

(SEQ ID NO: 482)
FKRNYLPGKHPRVVYLLYEIRWSRGTIWRSWCSNNATQHAEINFLETCFLARTSVSC
SITWVLSTTPCGKCSRRILEFLNAYPNVTLEIYAAKLFRHLDNRNRQGLRNLAMKGV
RIHIMNLADYSYFWKIFVAY

>A0A091GLR0_BUCRH/7-142

(SEQ ID NO: 483)
FTRNYLPNQHPRVVYLLYEIRWRRGTIWRNWCSNNSTQHAEIKFLENCFNATTSVSC
SIIWFLSTTPCGKCSTRILEFLRAHPNVTLEIYAAKLFKHHDNRNRRGLWNLAMNGV
KLHIMNPADYSYCWKMFVAY

>I3M955_ICTTR/250-417

(SEQ ID NO: 484)
FHLQFNNLHRPCRRKTYLCYQLRLGSLCDQDYFQNKDLHAEIRFIKKIRSLDLDQSH
NYEVTCYLTWSPCPDCAQELVALTRSHPVRLTLFTSRLYFHWLWRFQEGLRLLWR
SGVQIRVMSLREFTHCWVKFVNHGGCPFEPWDGLEQRSQSIQNRLNR

>G312J2_CRIGR/230-389

(SEQ ID NO: 485)
NRHRVRYQRKTYLCYLLEQNGQQPLKGCLQNKGKHAEILFIDEMRSLELGQVQITC
YLTWSPCPNCAQELAAFKSDHPDLVLRIYTSRLYFHWRRKYQEGLCCLWRSGIQVD
VMDLPQFADCWTNFVNQSPFWPWNNLEKNSRCIQRRLQR

>F7EWS7_RAT/229-389

(SEQ ID NO: 486)
NSHRVRYRRKSYLCYQLERNGQEPLKGYLLYKGQHVEILFLEKMRSMELSQVRITC
YLTWSPCPNCARQLAAFKKDHPDLILRIYTSRLYFYWRKKFQKGLCTLWRSGIHVDV
MDLPQFADCWTNFVNQRPFRPWNELEKNSWRIQRRLRR

>ABEC3_RAT/241-405

(SEQ ID NO: 487)
FYSQFYNQRVHGVKPYLCYQLEQNGQAPLKGCLLSEGQHAEILFLDKIRSMELSQVII
TCYLTWSPCPNCAWQLAAFKRDRPDLILHIYTSRLYFHWKRPFQKGLCSLWQSGILV
DVMDLPQFTDCWTNFVNKRPFWPWKGLEIISRRTQRRLHR

>A0A091EM42_FUKDA/548-715

-continued (SEQ ID NO: 488)
FRIQFNNAYKPHRRVTYLCYQVQKNGNLLTKGCLRTKGYHAESRFIKRICSLGLDQA
QSYQVTCFLTWSPCPRCAQELVLFKSSHPHLYLRIFTARLYFHWRKSYQEGLQRLCR
AQVPVAVMGYPEFAHCWYNFVDHPGPFEPWYKMEYYSKCIKKRFQR

>G5AYU5_HETGA/236-403

(SEQ ID NO: 489)
FRVQFNNAYKPRRRVTYLCYQLQENGDPLTKGCLRTKGYHAESRFIKRICSMDLGQ
DQSYQVTCFLTWSPCPHCAQELVSFKRAHPHLRLQIFTARLFFHWKRSYQEGLQRLC
RAQVPVAVMGHPEFAYCWDNFVDHPGPFEPWAKLEYYSSCLKRRLQQ

>T0NHJ8_CAMFR/587-753

(SEQ ID NO: 490)
FNKQFGNQPRPYRRKTYLCYQLKGNGSILAQGCVRNKQRHAEIRFIDKINFMNLNPN
QSYEIICYVTWSPCPTCAEKLVDLINDQVHLKLQIFASRLYFHWVRKYQIGLQYLWA
SQVTVAVMNRQEFKDCWEKFVDNGKDFQGWYKLEEYNRSISRRLNR

>B7T155_BOVIN/34-200

(SEQ ID NO: 491)
FKQQFGNQPRPYRRKTYLCYQLKQNDLTLDRGCFRNKQRHAEIRFIDKINSLDLNPS
QSYKIICYITWSPCPNCANELVNFITRNNHLKLEIFASRLYPHWIKSFKMGLQDLQNA
GISVAVMTHTEFEDCWEQFVDNSRPFQPWDKLEQYSASIRRRLQR

>F7IF99_CALJA/10-175

(SEQ ID NO: 492)
NIQLTNPYPKRTYLCYQLMPNGSTPTRGYFKNKNRHAEICFIDEIESMGLDKTQCYEV
TCYLTWSPCPSCAQKLVAFAKAQVHLNLRIFASRLYYHWLLSCKKGLQLLWKSQIP
VEVMGLPEFTDCWENFVVHGPPPFNPSEKLQELGSRSIKRRLDK

>A0A096NK51_PAPAN/9-179

(SEQ ID NO: 493)
FSLQFNNKRRPYPRKALLCYQLTPNGSTPTRGYLKNKKNHAEIRFINKIKSMGLDETQ
CYQVTCYLTWSPCPSCAGKLVDFLKAHRHLNLSIFASRLYYHWRPNYQEGLLLLCG
SQVPVEVMGLPEFTDCWENFVDHEPPSFNPSEKLEELDSRAIKRRLER

>A0A0D9R222_CHLSB/9-179

(SEQ ID NO: 494)
FSLQFNNKHHPYRRKALLCYQLTPNGSTPTRGQLQNKKDHAEIRFINKIKSMGLDET
QCYQVTCYLTWSPCPSCARELVDFIKAHNHLNLSIFASRLYYHWRPHYQEGLLLLCG
SRVPVEVMGLPEFTDCWENFVDHKPPSFNPSEKLDELDSQAIKRRLER

>F6SJ45_MACMU/9-179

(SEQ ID NO: 495)
FSLQFNNKRRPYPRKALLCYQLTPNGSTPTRGHLKNKKDHAEIRFINKIKSMGLDETQ
CYQVTCYLTWSPCPSCAGELVDFIKAHRHLNLRIFASRLYYHWRPNYQEGLLLLCGS
QVPVEVMGLPEFTDCWENFVDHKPPSFNPSEKLKELDSQAIKRRLER

>G1RYZ5_NOMLE/9-179

(SEQ ID NO: 496)
FRLQFNNKRRPYPRKALLCYQLTPNGSTPTRGYFKNKKRHAEIRFINKIKSMGLDETQ
CYQVTCYLTWSPCPSCAQELADFIKAHDHLNLRIFASRLYCHWCRRQQEGLRLLCGS
QVPVEVMGFSEFADCWENFVDYEPLSFNPSEMLEELDSRAIKRRLEK

>H2P4F3_PONAB/9-179

(SEQ ID NO: 497)
FSLQFNNKRRPYPRKALLCYQLTPNGSTPTRGYFKNKKCHAEIRFINEIKSMGLDETQ
CYQVTCYLTWSPCPSCVRELVAFIKAHDHLNLRIFASRLYCHWCRRQQEGLRLLCGS
QVPVEVMGSREFADCWENFVDHKPLSFNPSEMLEELDSRAIKRRLER

>H2QLQ0_PANTR/9-179

(SEQ ID NO: 498)
FRLQFNNRRRPYPRKALLCYQLTPNGSTPTRGYFENKKCHAEICFINEIKSMGLDETQ
CYQVTCYLTWSPCSSCAWKLVDFIQAHDHLNLRIFASRLYYHWCKPQQEGLRLLCG
SQVPVEVMGLPEFNDCWENFVDHEPLSFDPCKMLEELDSRAIKRRLER

>M4W6S4_HUMAN/9-179

(SEQ ID NO: 499)
FRLQFNNKRRPYPRKALLCYQLTPNGSTPTRGYFENKKCHAEICFINEIKSMGLDETQ
CYQVTCYLTWSPCSSCAWELVDFIKAHDHLNLGIFASRLYYHWCKPQQKGLRLLCG
SQVPVEVMGFPEFADCWENFVDHEPLSFNPYKMLEELDSRAIKRRLER

>F7AL68_MONDO/6-173

(SEQ ID NO: 500)
FLYHFKNVRWAGRHETYLCYVVKRDSATSFLDFGYLRNKGCHVELIFLRYISAWDL
DPSRCYRVTWFTSWSPCYDCARHVANFLRCYPNLTLRIFTARLYFCEDKKPEGLRRL
HRAGVQIAIMTFKDYFYCWNTFVENERTFKAWEGLHENSVRLSRQLRR

>G3W3P5_SARHA/11-178

-continued (SEQ ID NO: 501)
FLYHFKNVRWAGRHETYLCFVVKRDSATSFLDFGYLRNKGCHVELLFLQYISAWDL
DPSRCYRVTWFTSWSPCYDCARHVANFLRCYPNLSLRIFTARLYFCEDKKPEGLRRL
HQAGVPIAIMTFKDYFYCWNTFVENERTFKAWEGLHENSVRLSRQLRR

>F7A0K1_HORSE/11-178

(SEQ ID NO: 502)
FLYHFKNVRWAGRHETYLCYVVKRDSATSFLDFGHLRNKGCHVELLFLRYISDWDL
DPGRCYRVTWFTSWSPCYDCARHVADFLRGYPNLSLRIFAARLYFCEDRKPEGLRRL
HRAGVQIAIMTFKDYFYCWNTFVENERTFKAWEGLHENSVRLSRQLRR

>G3SM91_LOXAF/9-176

(SEQ ID NO: 503)
FLYQFKNVRWAGRHETYLCYVVKRDSATSFLDFGHLRNKGCHVELLFLRYISDWDL
DPGRCYRVTWFTSWSPCYDCARHVTDFLRGYPNLTLRIFTARLYFCEGRKPEGLRRL
HRAGVQIAVMTFKDYFYCWNTFVANERTFEAWEGLHENSVRLTRQLRR

>L9KY18_TUPCH/51-185

(SEQ ID NO: 504)
MYPLWGRHETYLCYVVKRDSATSFLDFGHLRNKGCHVELLFLRYISDWDLDPDRCY
RVTWFTSWSPCYDCARHVADFLRGYPNLTLRIFTARLYFCEDQKPEGLRRLHRAGV
QLAIMTFK

>W5NV85_SHEEP/11-181

(SEQ ID NO: 505)
FIYQFKNVRWAGRHETYLCYVVKRDSPTSFLDFGHIRNKGCHVELLFLRYISDWDLD
PGRCYRVTWFTSWSPCYDCARHVADFLRGYPNLSLRIFTARLYFCDKERKPEGLRQL
HRAGVQIAIMTFKDYFYCWNTFVENERTFKAWEGLHENSVRLSRQLRR

>H0W743_CAVPO/11-178

(SEQ ID NO: 506)
FLYQFKNVRWAGRHETYLCYVVKRDSATSCLDFGHLRNKGCHVELLFLRYISDWDL
DPGRCYRVTWFTSWSPCYDCARHVADFLRGNPNLSLRIFTARLYFCEDRKPEGLRRL
HRAGVQIAVMTFKDYFYCWNTFVENEKTFKAWEGLHENSVRLSRQLRR

>G3QLD2_GORGO/11-168

(SEQ ID NO: 507)
FLYQFKNVRWAGRRETYLCYVVKRDSATSFLDFGYLRNKGCHVELLFLRYISDWDL
DPGRCYRVTWFTSWSPCYDCARHVADFLRGNPNLSLRIFTARLYFCEDRKPEGLRRL
HRAGVQIAIMTFKENERTFKAWEGLHENSVRLSRQLRR

>AICDA_HUMAN/11-178

(SEQ ID NO: 508)
FLYQFKNVRWAGRRETYLCYVVKRDSATSFLDFGYLRNKGCHVELLFLRYISDWDL
DPGRCYRVTWFTSWSPCYDCARHVADFLRGNPNLSLRIFTARLYFCEDRKPEGLRRL
HRAGVQIAIMTFKDYFYCWNTFVENERTFKAWEGLHENSVRLSRQLRR

>G5BPM7_HETGA/64-219

(SEQ ID NO: 509)
FLYHFKNVRWAGRHETYLCYVVKRDSATSFLDFGYLRNKGCHVELLFLRYISDWDL
DPGRCYRVTWFTSWSPCYDCARHVADFLRGNPNLSLRIFTARLTGWGPAGLMSPAR
PSDYFYCWNTFVENERTFKAWEGLHENSVRLSRRLRR

>L5KIU3_PTEAL/6-173

(SEQ ID NO: 510)
FLYHFKNVRWAGRHETYLCYVVKRDSATSFLDFGHLRNQGCHVELLFLRYISDWDL
DPGRCYRVTWFTSWSPCYDCARHVADFLRGNPNLSLRIFTARLYFCDGFKPEGLRRL
HRAGVQIAIMTFKDYFYCWNTFVENEKTFKAWEGLHENSVRLSRQLRR

>F1SLW5_PIG/11-179

(SEQ ID NO: 511)
FLYQFKNVRWAGRHETYLCYVVKRDSATSFLDFGHLRNKGCHVELLFLRYISDWDL
DPGRCYRVTWFTSWSPCYDCARHVANFLRGNPNLSLRIFTARLYFCDGYKPEGLRR
LHRAGVQIAIMTFKDYFYCWNTFVENERSFKAWEGLHENSVRLTRQLRR

>S7N9P5_MYOBR/10-177

(SEQ ID NO: 512)
FLYHFKNVRWAGRHETYLCYVVKRDSATSFLDFGHLRNKGCHVELLFLRYISDWDL
DPGRCYRVTWFTSWSPCYDCARHVADFLRGNPNLSLRIFTARLYFCEDYKPEGLRRL
HRAGAQIAIMTFKDYFYCWNTFVENERTFRAWEGLHENSVRLSRQLRR

>G1TZP8_RABIT/6-173

(SEQ ID NO: 513)
FLYHFKNVRWAGRHETYLCYVVKRDSATSFLDFGYLRNTGCHVELLFLRYISDWDL
DPGRCYRVTWFTSWSPCYDCARHVADFLRGNPNLTLRIFTARLYFCEDRKPEGLRRL
HQAGVQLGIMTFKDYFYCWNTFVENERTFKAWEGLHENSVRLSRQLRR

>G3V7Y8_RAT/11-178

-continued (SEQ ID NO: 514)
FLYHFKNVRWAGRHETYLCYVVKRDSATSFLDFGHLRNKGCHVELLFLRYISDWDL
DPGRCYRVTWFTSWSPCYDCARHVAEFLRWNPNLSLRIFTARLYFCEDRKPEGLRRL
HRAGVQIGIMTFKDYFYCWNTFVENERTFKAWEGLHENSVRLTRQLRR

>G1KTX0_ANOCA/12-179

(SEQ ID NO: 515)
FLYHFKNLRWAGRHETYLCYVVKQNSATSCLDFGYLRNKGCHVEVLFLRYISTWDL
DPRHCYRITWFTSWSPCYDCARHVADFLSAYPNLSLRIFAARLYFCEERNPEGLRRL
HRAGAQIAIMTFKDYFYCWNTFVENKTTFKAWEGLHENSVRLARRLRR

>F7EGY6_XENTR/13-181

(SEQ ID NO: 516)
FLYHYKNLRWAGRHETYLCYIVKRYSSVSCLDFGYLRNRGCHAEMLFLRYLSVWV
GHDPHRAYRVTWFSSWSPCYDCAKRTLEFLKGHPNFSLRIFSARLYFCEERNPEGLR
KLQKAGVRLAVMSYKDYFYCWNTFVESERRFEAWDGLHENSVRLARKLRR

>H3ALQ6_LATCH/20-149

(SEQ ID NO: 517)
FLYHYKNVRWAGRHETYLCYIVKRYNPASYLDFGFLRNKGCHVEMLFLRFLTGWNI
DPTLPYSVTWFTSWSPCYDCSQHVTHFLRVYPNLRLRIFTARLYFCEENNPEGLRNL
HMAGVQLGVMT

>A0A0P7ULF7_9TELE/8-184

(SEQ ID NO: 518)
FIYHYKNVRWAGRHETYLCFVVKRDGPDTLFDFGHLRNRGCHVELVFLRHLGALCP
GLSYSVTWFCSWSPCYNCSRRLAHFLTRTPNLKLRIFCSRLYFCDVEDSSEGLRLLKR
AGVQLSVMTYKDYFYCWQTFVARERGFKAWEGLHQNSVRLARKLNR

>B3DGZ0_DANRE/15-191

(SEQ ID NO: 519)
FIFHYKNVRWAGRHETYLCFVVKRIGPDSLFDFGHLRNRGCHVELLFLRHLGALCPG
LCYSVTWFCSWSPCSKCAQQLAHFLSQTPNLRLRIFVSRLYFCDEEDSREGLRHLKR
AGVQISVMTYKDFFYCWQTFVARERSFKAWDGLHENSVRLVRKLNQ

>I3K4U3_ORENI/15-191

(SEQ ID NO: 520)
FLYHYKNVRWAGRNETYLCFVVKRVGPDSLFDFGHLRNRGCHVELLFLRQLGTLCP
GLSYSITWFCSWSPCANCSSRLAQFLKQTPNLRLRIFVSRLYFCDMEDSREGLRLLKK
VGVHITVMSYKDFFYCWENFVAQQSKFKAWEGLHQNTVRLARKLNR

>A0A0F8AS01_LARCR/15-192

(SEQ ID NO: 521)
FIFHYKNVRWAGRHETYLCFVVKRVGPDTLFDFGHLRNRGCHVELLFLRYLGALCP
GLSYSVTWFCSWSPCADCSFRLSQFLNRTPNLRLRIFVSRLYFCDMENSREGLRMLK
NAGAHITVMSYKDFFYCWQTFVARESNFKAWDELHRNSVRLSRKLHR

>H2SYA6_TAKRU/15-192

(SEQ ID NO: 522)
FIYHYKNVRWAGRHETYLCFVVKRVGPDTLFDFGHLRNRGCHVELLFLRYLGALCP
GLSYSVTWFCSWSPCVNCSIQLCQFLNNTPNLRLRIFVSRLYFCDLEDSREGLRMLTK
AGVRISVMSYKDYFYCWQKFVDCKSNFKAWEELHQNSVRLTRKLNR

>G3P8J1_GASAC/15-192

(SEQ ID NO: 523)
FIYHYTNMRWAGRHETYLCFVVKRVGPDSLFDFGHLRNRGCHVELLFLRHLGALCP
GFSYSITWFCSWSPCVNCSISLSQFLSRTPNLRLRIFVSRLYFCDMENSRDGLRMLKK
AGVQVTVMSYKDFFYCWQTFVDRQSQFKAWKELHQNSVRLSRKLKR

>W5L8S5_ASTMX/15-190

(SEQ ID NO: 524)
FIYHYKNVRWAGRHETYLCFVVKRIGPNSLFDFGHLRNRGCHVELSEIQSFSAFCPAL
VQNDSKSCRISTDSESLHQIETSLDKTPKTGIKVFLSLSLFVTLANHSHYPQMASDLCL
CVPIFLFTDFFYCWQTFVARESRFKAWDGLHQNSVRLSRKLKR

>H2M862_ORYLA/11-188

(SEQ ID NO: 525)
FIYHYKNMRWAGRHETYLCFVVKRVGPESLFDFGHLRNRGCHVELLFLRHLSALCP
GLSYSITWFCSWSPCANCSFRLAQFLSQTPNLRLRIFVSRLYFCDLEDSREGLRMLKK
VGVHITVMSYKDYFYCWQTFVARQSKFKPWDGLHQNSVRLSRKLNR

>A0A096M3S2_POEFO/26-203

(SEQ ID NO: 526)
FIYHYKNLRWAGRCETYLCFVVKKVGPDSLFDFGHLRNRNCHVELLFLRHLGALCP
GLSYSVTWFCSWSPCANCSIRLAQFLHQTPNLRLRIFVSRLYFCDLEDSREGLRILKK
AGVHITVMSYKDYFYCWQTFVAKQSKFKPWDGLHQNYIRLSRKLNR

>A0A087XZI4_POEFO/119-308

-continued (SEQ ID NO: 527)
FIYHYKNLRWAGRCETYLCFVVKKVGRNRLFDLNVTMNNKPLHLQLLFLRHLGALC
PGLSYSVTWFCSWSPCANCSIRLAQFLHQTPNLRLRIFVSRLYFCDLEDSREGLRILKK
AGVHITVMSYKDYFYCWQTFVAKQSKFKPWDGLHQNYIRLSRKLNR

>K7G3N4_PELSI/9-176

(SEQ ID NO: 528)
FLYNFKNLRWAGRHETYLCYVVKRDSATSFLDFGYLRNKGCHVEMLFLRYISAWDL
DPGRCYRVTWFTSWSPCYDCARHVADFLRAYPNLTLRIFAARLYFCEDRNPEGLRR
LHRAGVQIAIMTFKDYFYCWNTFVENERTFKAWEGLHENSVRLSRRLRR

>A0A151P6G3_ALLMI/11-178

(SEQ ID NO: 529)
FLYNFKNLRWAGRHETYMCYVVKRDSATSCLDFGYLRNKGCHVEVLFLRYISAWD
LDPGRCYRVTWFTSWSPCYDCARHVADFLRAYPNLTLRIFVARLYFCEGRNPEGLR
RLHRAGAHIAIMTFKDYFYCWNTFVENERTFKAWEGLHENSVHLTRKLRR

>A0A091GPU6_BUCRH/9-176

(SEQ ID NO: 530)
FLYNFKNLRWAGRRETYLCYVVKRDSATSCMDFGYLRNKGCHVELLFLRYISAWD
LDPGRCYRITWFTSWSPCYDCARHVADFLRAYPNLTLRIFAARLYFCEDRKPEGLRR
LHRAGAQIAIMTFKDYFYCWNTFVENEKTFEAWEGLHENSVHLTRKLRR

>A0A093H5I2_PICPB/9-176

(SEQ ID NO: 531)
FLYNFKNLRWAGRRETYLCYVVKRDSATSCLDFGYLRNKGCHVEVLFLRYISAWDL
DPGRCYRITWFTSWSPCYDCARHVADFLRTYPNLTLRIFAARLYFCEDRKPEGLRRL
HKAGAQIAIMTFKDYFYCWNTFVENEKTFKAWEGLHENSVHLSRKLRR

>A0A099YYC6_TINGU/9-176

(SEQ ID NO: 532)
FLYNFKNMRWAGRRETYLCYVVKRNSATSCLDFGYLRNQGCHVEVLFLRYISAWD
LDPGRCYRITWFTSWSPCYDCARHVADFLRAYPNLSLRIFTARLYFCEDRKPEGLRR
LHRAGAQIAIMTFKDYFYCWNTFVENEKTFKAWEGLHENSVRLSRQLRR

>A0A091RVC9_NESNO/9-176

(SEQ ID NO: 533)
FLYNFKNLRWAGRRETYLCYVVKRDSATSCLDFGYLRNQGCHVEVLFLRYISAWDL
DPGRCYRITWFTSWSPCYDCARHVANFLRAYPNLTLRIFTARLYFCEDRKPEGLRRL
HRAGAQIAIMTFKDYFYCWNTFVENEKTFKAWEGLHENSVHLSRKLRR

>A0A091MHE0_9PASS/9-176

(SEQ ID NO: 534)
FLYNFKNLRWAGRRETYLCYVVKRDSATSYLDFGYLRNQGCHVEVLFLRYISAWDL
DPGRCYRITWFTSWSPCYDCARHVANFLHSYPNLTLRIFTARLYFCEDRKPEGLRRL
HKAGAQIAIMTFKDYFYCWNTFVENEQTFKGWEGLRENSVHLSRKLRR

>A0A093PQH0_9PASS/9-176

(SEQ ID NO: 535)
FLYNFKNLRWAGRRETYLCYVVKRDSATSCLDFGYLRNQGCHVEVLFLRYIAAWD
LDPGRCYRITWFTSWSPCYDCAQHVANFLRSYPNLTLRIFTARLYFCEDRKPEGLRR
LHKAGAQIAIMTFKDFFYCWNTFVENEQTFKGWEGLHENSVHLSRKLRR

>A0A091EUR4_CORBR/9-176

(SEQ ID NO: 536)
FLYNFRNLRKAGRRETYLCYVVKRDSATSCLDFGYLRNQGCHVEVLFLRYIAAWDL
DPGRCYRITWFTSWSPCYDCAQHIANFLRSYPNLTLRIFMARLYFCEDRKPEGLRRL
HKAGAQIAIMTFKDYFYCWNTFVENEQTFKGWEGLHENSVHLARKLRR

>T0NHJ8_CAMFR/146-317

(SEQ ID NO: 537)
FTHNFSNHKRTHKTYLCYEVEIHGDSGIPDKGFLCNKCHVELYLLGRIRSWKLDRKL
HCRLTCFISWTPCGTCARELAEFLKENSHVSLCIFASRIYSLNDYEAGLRTLQEAGAQI
AIMTFKEFRHCWETFVDHGRPFQPWDELDINSQGLSKELQA

>H9GWR3_CANLF/15-197

(SEQ ID NO: 538)
FTQNFRNDNPSKTYLCYQVELDGSSGVLDKGSAFPGGQHAEWFLLEHIRSRNLDQK
LSYKVTCFLSWTPCEKCAEEIIRFLAKNRHVSLSILASRIYTMGPYVKGLRELYDAGV
HISIMTFRDFEYCWQTFVDHDSPFQPWADLDRRSQQLSQQLRA

>H0XN38_OTOGA/18-197

(SEQ ID NO: 539)
FTSNFTNNPAIGRRQTYLCHEVQLDGDSWVLDRGFLQSQPLHAEFCFLDRVGSWQL
NPNWHYRVTCFISWSPCFSCAQKVAMFLRRNSHVKLRILAARIYDYHPGYEEGLKA
LQGTGAQVAIMTHAEFEHCWDTFVDHGRPFQPWEGLDKNSQALSRRLQD

>G3SVX3_LOXAF/11-178

-continued (SEQ ID NO: 540)
FRFNFINDASVGQKQTYLCYEVELDGNSWVLDRGFLLNQRRHAELCFLDRVSSWHL
DPTKHYKFTWFLSWSPCRNCAQEVVAFLGGNSHVSLSIFAPRIYDYYSGYEEGLRSL
QGAGAHVSIMTSTEFEHCWRTFVDNGCPFVPWNRLGENSQTISRRLQS

>G3TLG1_LOXAF/31-201

(SEQ ID NO: 541)
FQLNFINDLSVGQKQAYLCYEVELDCNSRVLNRGFLCNQGCHAELCFLDQVPSWQL
DLVLCYRVTWFISWSPGPDCAQEVAAFLRGNSHVSLSIFASCIYDSVEESEGGWKGK
KDLGASKKKFGHCWKTIVDNGRFFEPWNRLDESFDFLDLT

>G1TLT9_RABIT/18-182

(SEQ ID NO: 542)
FMDHFANEDGGGLNETYLCYEVQLDGSSQGFLRNKRRHAELCFLDLVPAWRLDPA
QHYRVTWFISWSPCFLCAQAVAEFLRRNAHVSLRIFAARIYTWRTDYKAGLQDLQR
AGAQIAIMTPAEIQFCWNTFVDNSNPFHSHLGLGHAKPA

>S7N2R7_MYOBR/2-126

(SEQ ID NO: 543)
CFDGNNRRPRAELCFLALFQSWHLNEGKQYRLTWYSSWSPYPDCVPKLVEFLGDNS
NVSLRIFAAGIHSIFTGYKRELRNLRDAGAQLAIMTLEELRWELGGEMATWRWQNE
N

>L7N100_MYOLU/15-180

(SEQ ID NO: 544)
FKENFANTWENETELCYEVEVEGDTWAVEQGFLCNQPCHAELCFLCLVRSWHVDE
GKQYRLTWHISWSPCPNCAQKLVKFLHDNSHVSLRIFAAGIQTTFSGHEDWLRKLRD
SGAQLAIMTLKELQHCWDTFVDNGQPFEPWPNLVEHIQTESQKLKD

>G1Q326_MYOLU/19-187

(SEQ ID NO: 545)
EWNFGITWAKETYLCYEVEVEGDAWAKEGFLRNELRHAELCFLRGVSDWDLDEG
KQYRLTYMSWSPCPNCAPKLVEFLDENSHVTLRIFPARIHTKSRGYQDGLRNLRDAG
AQLAIMTLKEHQHCWDTFVDNGQPFRPWPNLVEHIETKSQELKD

>G1PQB2_MYOLU/4-177

(SEQ ID NO: 546)
FKDNFGHNWEKTYLWYEVEFEGDAWAVEQGFLRNQLRHAELCFLHGVRSWHLDE
GKQYRLTWHISWSPCPDCASKLVEFLGENSHVSLRIFAARIHTKYRGYEDGLRQLQD
AVDHLTIMTLKELQHCWVTFVDNGQPFEPEIELLENIGAQCQKLES

>L5M566_MYODS/4-175

(SEQ ID NO: 547)
FKDNFGITWANETYLCYEVEVEGDAWAVEQGFLRNQRSHAELCFLDRVPSWHLDE
GKQYRLTCYISWSPCPDCAQKLVEFMGENSHVSLRIFAARIYTKLDGHEDGLRKLQD
AGAQLAIMTLKEYEHCWDTFVDSGQLFRARDELEVHIGAQCQRLEN

>G1QB54_MYOLU/17-183

(SEQ ID NO: 548)
FKRNFRNKCKNQTYLCYEVEVEGNAWAVEQGFLRNQRRHAELCFLDRVPCWNLDG
LKKYRLTCYISWSPCPDCALELVQFLGLKSNVSLRMCTAGIRTTFPGHEDGLRNLRD
AGAQLTIMTRDEYEHCWDTFVDNGQPFRARDELEGHDYFLL

>G1NTH0_MYOLU/7-175

(SEQ ID NO: 549)
EVNFGHDWEKKTYLCYEVEVEGDAWVGKQGFLCNQPGHAELCFLDRVRSWHLDG
GKQYRLTCYMSWTPSPDCALELVQFLSENSHVSLRIFAAGIRTRFHGHEDGLRQLRD
AGAQLAIMTLHELQHCWDTFVDNGQPFRARDELEVHIGAQCQKLKS

>L7N100_MYOLU/194-364

(SEQ ID NO: 550)
KRRNFRNKCENQTYLCYEVEVKDGKWTVEQGFLRNQPGHAELCFLDRVRSWHLDE
GRQYRLTCYISWTPGPDCAQKLVEFLGENRHVSLRIFAAGIHTKYRGHEDGLRQLW
DAGAQIAIMTLNELQHCWETFVDNGQPFEPWPIQVEHIQTESQKLKD

>G1QB54_MYOLU/248-406

(SEQ ID NO: 551)
AEKLFFKKLLQQVYYCFGLKIEGRDQPRHAELCFQDRVRSWHLDEGKQYRLTCYIS
WSPCPDCAQKLVEFLGENSHVRLRIFAARIYKKRDRYKHWLRQLRDAGAQLTIMTL
NELQHCWVTFVDNGQRFEP

>G1PBV8_MYOLU/144-276

(SEQ ID NO: 552)
FRVNFSYYRERKTYLCYEVEVEGDAWVVKQDFLRNQPRHAELCFLDGVRSWHLDE
GKQYRLTCYISWSPCPVCAQELVEFLGENRHLRLRIFAARIYSIVSGYEDGLRQLWDA
GAPLAIM

>G1Q0Q6_MYOLU/140-315

-continued (SEQ ID NO: 553)
FKDNFSHRRARRTYLCYQVEVEGDAWAVEYGFLCNQLRHAELCFLDRVPFWNLEE
GRQYRLTCYISWSPCPDCAQRLVEFLGNNNHMRLRIFAARIYTFVSGHEDGLRQLW
DAGAQLTIMTRNDLQHCWDTFVDNGDPFEPCPIQVEHIGTESQELEN

>G1Q0G3_MYOLU/13-186

(SEQ ID NO: 554)
FKENFSHRRARKTYLCYEVEVEGNTWAVEQGFLHNQLRHAELCFLDRVRFWNLEE
GRQYRLTCYISWSPCPDCAQKLVEFLGQNSHVSLCIFAARIYTIVSGYKDGLCQLRDA
GAQLTIMTLNDLQHCWENLVDNGEPFEPCPTLVEHIETKSQELKD

>A0A096NK44_PAPAN/18-195

(SEQ ID NO: 555)
FTFNFNNDLSVGRHQTYLCYEVERDNGTWVMDRGFLHNKGCHAELCFLGEVPSWQ
LDPAQTYRVTWFISWSPCLRRGCAEQVRAFLQENTHVRLHIFAARIYDFDFLYQEAL
RTLRDAGAQVSIMTYEEFKHCWDTFVDHGRPFQRWDGLDEHSQDLSGRLRA

>A0A0D9R289_CHLSB/198-375

(SEQ ID NO: 556)
FTINFNNDLSVGRRQTYLCYEVERDNGTWVMDWGFLCNQSCHVELCFLSQVSSWQ
LDPAQTYRVTWFISWSPCFSGGCAEQVRAFLQENTHVRLCIFAARIYNYDPLYQEAL
RMLRDAGAQVSIMTYEEFEYCWDTFVDRGCPFQPWDGLDEHSQALSGRLRA

>F7FXK1_MACMU/18-195

(SEQ ID NO: 557)
FTSNFNNDVSVGRHQTYLCYEVERDNGTWVMDWGFLCNQGCHAELCFLGWVPSW
QLDPAQTYRVTWFISWSPCFSWGCAEQVRAFLQENTHVRLHIFAARIYDYDPLYQEA
LRTLRDAGAQVSIMTYDEFEYCWDTFVDCGCPFQPWDGLDEHSQALSERLRA

>GIRYY7_NOMLE/198-375

(SEQ ID NO: 558)
FTFNFNNDPLVGRHQTYLCYEVERDNGTWVMDRGFLHNQGRHTELCFLGLIPYWQL
DLAQTYRVTWFISWSPCFSWGCAEQVRAFLQENTHMRLRIFAARIYDYDPLYKEAL
QMLRGAGAQVSIMTYDEFEHCWDTFVDHGRPFQPWDGLEEHSQALSGRLQA

>H2P4E7_PONAB/198-375

(SEQ ID NO: 559)
FTFNFNNDPFVRRHQTYLCYEVEHDNGTWVMDRGSLHNQGRHAELRFLGLLPYWQ
LDPAQIYRVTWFISWSPCFSWGCARQVRAFLQENTHVRLRIFAARIYDYDPLYKEAL
QMLRDAGAQVSIMTYDEFEYCWNTFVDHGCPFQPWDGLEEHSQALSGKLQA

>GIRYY4_NOMLE/16-192

(SEQ ID NO: 560)
FTSNFNNGRWHKTYLCYEVERDNGTWVMDRGFLHNQGRHAELCFLDLVPSLQLDP
AQTYRVTWFISWSPCFSWGCAEQVRAFLQENTHVRLRLFAARIYDYDPLYKEALQM
LRGAGAQVSIMTYHEFKHCWDTFVDHGRPFQPWDGLEEHSQALSGRLQA

>H2QLP4_PANTR/16-192

(SEQ ID NO: 561)
FTSNFNNGGRRKTYLCYEVERDNGTSVMDRGFLHNQGRHAELRFLDLVPSLQLDPA
QIYRVTWFISWSPCFSWGCAGQVRAFLQENTHVRLRIFAARIYDYDPLYKEALQMLR
DAGAQVSIMTYDEFKHCWDTFVDHGCPFQPWDGLEEHSQALSGRLRA

>G3S2J9_GORGO/18-195

(SEQ ID NO: 562)
FTSNFNNDLLVRRHQTYLCYEVERDNGTWVMDRGFLHNQGRHAELRFLDLVPSLQL
DPAQIYRVTWFISWSPCFSWGCAGQVCEFLQENTHMRLRIFAARIYDYDPLYKKALQ
MLRDAGAQVSIMTYDEFKHCWDTFVYRGCPFQPWDGLEEHSQALSGRLQA

>H2QLP5_PANTR/198-375

(SEQ ID NO: 563)
FTFNFNNDPLVRRHQTYLCYEVERDNGTWVMDMGFLCNEGRHAELRFLDLVPSLQ
LDPAQIYRVTWFISWSPCFSWGCAGQVRAFLQENTHVRLRIFAARIYDYDPLYKEAL
QMLRDAGAQVSIMTYDEFEYCWDTFVYRGCPFQPWDGLEEHSQALSGRLRA

>G3QV16_GORGO/198-375

(SEQ ID NO: 564)
FTFNFNNDPLVRRHQTYLCYEVERDNGTWVMDMGFLCNEGRHAELRFLDLVPSLQ
LDPAQIYRVTWFISWSPCFSWGCAGQVCEFLQENTHMRLRIFAARIYDYDPLYKKAL
QMLRDAGAQVSIMTYDEFKHCWDTFVYRGCPFQPWDGLEEHSQALSGRLQA

>A0A096N7U5_PAPAN/178-346

(SEQ ID NO: 565)
FTYNFTNDPSVGQHQTYLCYKVECDNDTWVLDKGILPNQHAEQYFLYLISFWKLDQ
AQCYRVTWFISWSTCFSCAQQVATFHWENRCVSLHIFIARIYNLPGYEGLCMLQRA
GTQISIMTSKFRHCWVTFVDHGHPFQPWDGLDEHSQALSGRLQA

>F6QUT3_MACMU/171-340

(SEQ ID NO: 566)
FTYNFTNDPSVGQHQTYLCYKVECDNDTWVLDKGILPNQHAEQYFLYLISFWKLDR
AQCYRVTWFISWSTCFSCAQQVTTFHWENRCVSLHIFVACIYNYLPGYEGLCMLQR
AGTQISIMTSGFRHCWVTFVDHGHPFQPWDGLDEHSQALSGRLQA

>H9KW44_CALJA/143-282

(SEQ ID NO: 567)
FTYNFTNDPSVGRHQTYLCYEVEHHNGTWVLHRGFILNEGRHAELCLLDLILFWKL
DLAQRYRVTCFISWSPCFCCAEKVAEFLQENPHVNLRIFAARIYGYQRGYKKGLRRL
NRAGAPISMMKYS

>F7CUA6_CALJA/202-377

(SEQ ID NO: 568)
FTYNFTNDPSVGQHQTYLCYEVEHHNGTWVLHRGFILNQGRHAELCLLDLISFWKL
DLAQYYTVTCFISWSPCFSCAEKVAEFLQENPHVNLHIFAAHIYGYQRGYIKGLCRLN
RAGAPISMMKYSEFSYCWDTFVDHEHPFQPWEGLDEYTQALSGKLQA

>A0A0D9R229_CHLSB/213-376

(SEQ ID NO: 569)
FTSNFNNKPWVGQRETYLCYKVERHNDTWVLNRGFLRNQGRHAELCFLDLIPFWKL
DDQQYRVTCFTSWSPCFSCAQKMAKFISKNKHVSLCIFAARIYDDQGRCQEGLRTLH
RDGAKIAVMNYSEFEYCWDTFVDRGXXXXLGVKPDC

>ABC3G_PAPAN/202-376

(SEQ ID NO: 570)
FTSNFYNKPWVGQHETYLCYKVERHNGTWVLNRGFLRNQGRHAELCFLDLIPFWKL
DGQQYRVTCFTSWSPCFSCAQEMAKFISNNEHVSLCIFAARIYDDQGRCQEGLRTLH
RDGAKIAMMNYSEFEYCWDTFVDRGRPFQPWDGLDEHSQDLSGRLRA

>ABC3G_MACMU/195-369

(SEQ ID NO: 571)
FTSNFNNKPWVGQHETYLCYKVERHNDTWVLNRGFLRNQGRHAELCFLDLIPFWKL
DGQQYRVTCFTSWSPCFSCAQEMAKFISNNEHVSLCIFAARIYDDQGRYQEGLRALH
RDGAKIAMMNYSEFEYCWDTFVDRGRPFQPWDGLDEHSQALSGRLRA

>H2P4E9_PONAB/216-391

(SEQ ID NO: 572)
FTSNFNNEPCVGRHETYLCYKVERHNDTWVLNRGFLCNQGRHAELCFLDVIPFWKL
DGKQRYRVTCFTSWSPCFRCAQEMAKFISNNQHVSLCIFAARIYDDQGRCKEGLRTL
DEAEAKISIMTYSEFQHCWDTFVDHGRPFQPWDGLEEHSEAWSGKLQA

>ABC3G_GORGO/202-377

(SEQ ID NO: 573)
FTSNFNNEHWVGRHETYLCYEVERHNDTWVLNRGFLCNQGRHAELCFLDVIPFWKL
DLHQDYRVTCFTSWSPCFSCAQEMAKFISNKKHVSLCIFAARIYDDQGRCQEGLRTL
AEAGAKISIMTYSEFKHCWDTFVYHGCPFQPWDGLEEHSQALSGRLQA

>G3SFB6_GORGO/202-375

(SEQ ID NO: 574)
FTSNFNNEHWVGRHETYLCYEVERHNDTWVLNRGFLCNQGRHAELCFLDVIPFWKL
DLHQDYRVTCFTSWSPCFSCAQEMAKFISNKKHVSLCIFAARIYDDQGRCQEGLRTL
AEAGAKISIMTYSEFKHCWDTFVDHGCPFQPWDGLEEHSQSLGDRA

>L9KAV2_TUPCH/18-186

(SEQ ID NO: 575)
FNFHYKNLQRAGRRKTYLCYLLEEEREGAIVLDVGVLHNQEHAERRFLSSPDILQLL
DGGRRYRVTWYLSWSPCSQCARAVAGFLAQHGNVSLRIFVARLYNHEDPENRQGL
RTLNSTGTPIRVMTNREFALCWERFVRHQGAAFEPWAGLRENADLLLGQLED

>Q6DIS6_XENTR/55-231

(SEQ ID NO: 576)
FMFQFKNVEYSGRNKTILCYTVERPEGQVFHGYLEDESAHAEDAFFTSVLPQLTSGS
VTVTCYVSSSPCVNCAASVAQCLRRNKTVRIQLAVARLFQWEEPEIRRALKGLRSAG
CQVRMMRGADYVYVWKNFVEPDHQDFIPWEDLEENARYYEEKLEE

>A0A0P7WIY8_9TELE/108-272

(SEQ ID NO: 577)
FKFQFKNVEYSGRNKTFLCFLVDVQGSGGEGLRGYLEDEGAHAEEAFFQQVLPQDS
ALHYMVTWYVSSSPCAACTAKLVEILKARKTMRLTIFSARLFMWEEPEIQVGLKAL
AAAGCKLRMMKPTDFVYIWDTFVENDQTFTPWEDCQENYEYYQEKLAD

>F1RAQ7_DANRE/104-270

(SEQ ID NO: 578)
FKFQFKNVEYSGRNKTFLCYQVDIQGGETDGVRGYLEDEGSHAEEAFFQQVLAYDK
SLRYTVTWYTSSSPCVACAAKLVEILKARKALRLNIHCSRLFEWEEPEIQAGLQALVR
AGCKLRMMRPVDFVYVWSTFVENEDNFTPWEDCQDNFEYYDERLQD

>H2LVW2_ORYLA/81-243

-continued (SEQ ID NO: 579)
FKFQFRNVEYSGRNKTLLCFRVDTAGGSTEPLRGYMEDETAHAEEAFFQQVLPNSSQ
EYDVTWYVSSSPCVACAAKLTSILQQRKKLRLSVFCSRLFDWEEPEIVQGLKALVQA
GCKLQMMKPADFQHVWETYVEKDQSFTLWEDCKENYEYYLEKLAD

>A0A087X5U3_POEFO/101-263

(SEQ ID NO: 580)
FKFQFRNVEYSGRNKTLLCFRVDTAGGNAEPLKGYMEDETAHAEEAFFQQVLPNSS
TEYDVTWYVSSSPCVACAAKLANILQQRKKLRLSIFCSRLFEWEEPEIVEGLKALARA
GCKLRMMKPIDFQHVWEMYVEQGESFTPWEDCQENYEYYVERLTD

>G3P582_GASAC/83-245

(SEQ ID NO: 581)
FKFQFRNVEYSGRNKTLLCFRVDTPGGSTEPLKGYMEDETAHAEEAFFQQVLPNTSQ
EYEVTWYLSSSPCVACAAKLAHILQQRKKVRLRMFCSRLFEWEEPEIVEGLRALVSA
GCKLRMMKPSDFVHVWETYVEKDQNFEAWEDCQENYDYYVEKLTD

>H2U6E4_TAKRU/97-259

(SEQ ID NO: 582)
FKFQFRNVEYSGRNKTLLCFRVDSPGGSTEPLKGYMEDETAHAEEAFFQQVLPNPSL
EYDITWYVSSSPCISCANTLAKMLQQRKKVRLCVFCSRLFEWDQPEVVEAIRTLVRA
GCKLRMMKPSDFQHVWETYVEKGESFTPWEDCQDNYNYYKEILAD

>A0A0P7V3P5_9TELE/68-234

(SEQ ID NO: 583)
FKFQFKNVEYSGRNKTLLCFLVDSQKGEDELQRGYLEDEGAHAEEAFFQQVLPEDP
GRRYQVTWYVSSSPCAACAAKLAEILRARPTLRLTIFSARLFMWEEPEIQEGLKALA
AAGCKLRVMKPVDFSYTWDTFVENDQTFSPWEDCQENYEYYQEKLAG

>W5KNC9_ASTMX/26-194

(SEQ ID NO: 584)
FRFQFKNVEYCGRNKTLLCYLVDQSSGADGLLRGFLEDEGLHAELAFFQLILPQDPS
VNYTVTWYVSSSPCAHCCSKLLEILQERKTLRLNIFSARLLEAEEEEGQAGMKALAG
AGCKLRVMKPLDFSYSWDTFVEHDERFTPWEDCQENYEYHHEKLAQ

>H2M4W2_ORYLA/70-234

(SEQ ID NO: 585)
FKFQFKNVEYSGRNKTLLCYLVDTGGAGDGLLRGYLEDEGIHAEEAFFTHCLPNDPN
VQYTITWYVSSSPCHACSLKLAEVLKARKNVKLSIFSARLFEWEAEEVQAGLKALHS
AGCKLRVMKPLDFSYTWDTFVETEQPLNLWEDCKDNYEYYHEKLDQ

>H2TE47_TAKRU/80-244

(SEQ ID NO: 586)
FQFQFKNVEYSGRNKTFLCYLVDTGKADEGLQRGYLEDEGSHAEEAFFTQCLPHDP
ALKYSVTWYMSSSPCCACAAKMAEALKARRNIKLSIFAARLFEWEEAEIQAGLKAL
HIAGCKIRVMKPLDFSYTWDTFVENDQPLNLWADCKENYEYYHERLAD

>I3JAF9_ORENI/80-244

(SEQ ID NO: 587)
FKFQFKNVEYSGRNKTLLCYLVDKGNTSDGLLRGYLEDEGTHAEEAFFTQCLPHNP
ALKYTVTWYVSSSPCSACAAKIAELLKDQKNLKLNIFAARLFEWEEGEIQAGLRTLH
AAGCKLRVMKPLDFSYTWDTFVENDQSLNLWEDCKENYEYYHEKLSD

>A0A0F8BFJ4_LARCR/500-664

(SEQ ID NO: 588)
FKFQFKNVEYSGRNKTFLCYLVDKGNTADGLLRGYLEDEGSHAEEVFFIQCLPHDPT
LKYTVTWYVSSSPCSACAAKIAEVLKARKNVKLSIFAARLFECEEVEIQAGLKALHA
AGCKLRVMKPLDFSYTWDTFVENEQPLNLWEDCKENYEYYHEKLAD

>G3PCV8_GASAC/21-185

(SEQ ID NO: 589)
FKFQFKNVEYSGRNKTFLCYLVDKGNTDDGLLRGYLEDEGSHAEEAFFIQCIPNDPS
VRYTVTWYVSSSPCAACAAKIAEVLKARKNIKLSIFAARLFECEETDIQAGLKAMHT
AGCKLRVMKPLDFSYTWDTFVENEEPLNLWEDCKENYEYYQEKLAD

>A0A151P4M1_ALLMI/14-181

(SEQ ID NO: 590)
FKFQFKNVEYSGRNKTFLCYIVETQGKESGTIRGYLEDEAAHAEDAFFNTILPEESSLR
YNVTWYVSSSPCVACAERIAEILKKNKNLRLAILVSRLFMWEEPEMQAVLKKMKAA
GCKLRIMKPQDFEYVWQNFVEQESKDFVPWEDIQENFLYYEEKLAE

>K7G457_PELSI/58-225

(SEQ ID NO: 591)
FKFQFRNVEYSGRNKTFLCYIVETQGKESGSFRGYLEDEAAHAEGAFFNNILPTEPSL
RYNVTWYVSSSPCVPCADQIAQILQKNKNLRLTILVSRLFMWEEPEMQAALKKLKT
AGCKLKIMKPQDFEYIWQNFVEQEAKAFEPWEDIQENFLYYEEKLAE

>M7B9Y3_CHEMY/50-217

(SEQ ID NO: 592)
FKFQFRNVEYSGRNKTFLCYVVEIQGKEPGSFQGYLEDEAAHAEDAFFNNILPTDPN
LRYNVTWYVSSSPCVPCADRIAQVLQKNKNLRLSILVSRLFMWEEPEMQAALKKLK
ASGCKLKIMKPQDFEYIWQNFAEQEAKAFEPWEDIQENFLYYEEKLSE

>V8P1W3_OPHHA/51-183

(SEQ ID NO: 593)
FNFQFKNVEYSGRNKTFLCYIIEIQGKESKMLRGYLEDEAAHAEDAFFNTILPKESGM
CYNVTWYSSCSPCIGCADRIAKALQKNKNLHLSIAVGRLFMWEEPDMQAALKKMK
TAGCKLRIMKPQDFEY

>G1KSP1_ANOCA/17-185

(SEQ ID NO: 594)
FKFQFKNVEYSGRNKTFLCYIIEMQGKESKTLRGYLEDEAAHAEEAFFNTILPTEPGF
RYEVTWYVSSSPCVSCAERIVKALKKNKNLRLSIAVGRLFMWEEPDIQAALKQMKA
AGCKLRIMKPQDFEYVWKNFVEQEPKAFAPWDDIQENFQYYDEKLAE

>R7VNA1_COLLI/52-220

(SEQ ID NO: 595)
FKFQFRNVEYSGRNKTFLCYVVETQGRESVTSRGYLEDEAAHAEMAFFNTILPKESS
ARYNVTWYVSSSPCVTCADRITETLKKNKNLRLTIMVGRLFMWEEPEMQAALKNM
RAAGCKLRIMKPQDFEYVWQNFVEQEAKAFAPWEDIQENFQYYEEKLAE

>H1A4Q1_TAEGU/51-219

(SEQ ID NO: 596)
FKFQFRNVEYSGRNKTFLCYVVETQGKEPVTSRGYLEDEAAHAEMAFFNTILPTQAG
ARHDVTWYVSSSPCVTCAQRICEALRKNKGLRLTIMVGRLFMWEEPEMQAALRSM
KEAGCKLRIMKPQDFEYVWKNFVEQEAKSFVPWEDIQENFQYYEEKLAE

>R0L7B9_ANAPL/57-225

(SEQ ID NO: 597)
FKFQFRNVEYSGRNKTFLCYVIETQGKESVTSRGYLEDEAAHAEIAFFNTILPKESSLR
YNVTWYVSSSPCVTCADRITETLKKNKNLRLTIMVGRLFMWEEPEMQAALKKMKS
AGCKLRIMKPQDFEYVWQNFVEQEAKAFVPWEDIQENFQYYEEKLAE

>A0A0Q3TEK9_AMAAE/51-219

(SEQ ID NO: 598)
FKFQFRNVEYSGRNKTFLCYVVETQGKESATSRGYLEDEAAHAEMAFFNTILPKDSS
LRYNITWYVSSSPCVTCAERIIETLKKNKNLRLTIMVGRLFMWEEPEMQAALKNMKS
AGCKLRIMKPQDFEYVWQNFVEQEAKDFVPWEDIQENFNYYEEKLAE

>F1NNK5_CHICK/51-219

(SEQ ID NO: 599)
FKFQFRNVEYSGRNKTFLCYVVETQGKESKTSRGYLEDEASHAEIAFFNTILPKESSL
RYNITWYVSSSPCVTCADRISETLRKNKNLRLTIMVGRLFMWEEPEMQAALKKMKS
AGCKLRIMKPQDFEYVWQNFVEQEAKAFVPWEDIQENFQYYEEKLAE

>F6PKH9_ORNAN/19-179

(SEQ ID NO: 600)
FKFQFRNVEYSGRNKTFLCYVVETQGKENQTARGYLEDEAAHAEEAFFNSILPADQA
LKYNVTWYVSSSPCAACADRIADTLRRTPNLRLLLLVGRLFMWEEPEIQAALKKLK
AAGCKLRIMKPQDFEYVWQNFVEQEAKAFVPWEDIQENFLY

>F7EXQ1_MONDO/49-218

(SEQ ID NO: 601)
FKFQFRNVEYSGRNKTFLCYVVEVQGKQGQISRGYLEDEAAHAEEAFFKTILPTDPA
LRYNVTWYVSSSPCAACADRISSTLSKTKNLKMLLLVGRLFMWEEPEIKTALKKLKE
SGCKLRIMKPQDFEYVWQNFVEQESKAFVPWEDIQENFLYYEEKLAE

>G3WZU9_SARHA/50-219

(SEQ ID NO: 602)
FKFQFRNVEYSGRNKTFLCYVLEVQGKQGQMSRGYLEDETAHAEEAF
FKTILPTDPALRYNVTWYVSSSPCAACADRISSTLSKNKNLRMLLLVGRLFMWEEPEI
KAALKRLKEAGCKLRIMKPQDFEYVWQNFVEQESKAFVPWEDIQENFLYYEEKLAE

>I3N5I3_ICTTR/52-221

(SEQ ID NO: 603)
FKFQFRNVEYSGRNKTFLCYVVEAQGKQVQASRGYLEDEAAHAEEAFFNTILPTDPS
LRYNVTWYVSSSPCAACADRIIKTLGKTKNLRLLILVGRLFMWEEPEIQTALKKLKE
AGCKLRIMKPQDFEYIWQNFVEQESKAFEPWEDIQENFLYYEEKLAD

>A0A0B4J211_PONAB/52-221

(SEQ ID NO: 604)
FKFQFRNVEYSGRNKTFLCYVVEAQGKQVQASRGYLEDEAAHAEEAFFNTILPADP
ALRYNVTWYVSSSPCAACADRIIKTLSKTKNLRLLILVGRLFMWEELEIQDALKKLK
EAGCKLRIMKPQDFEYVWQNFVEQESKAFQPWEDIQENFLYYEEKLAD

>F6QZ00_CALJA/52-221

-continued (SEQ ID NO: 605)
FKFQFRNVEYSGRNKTFLCYVVEAQGKQVQATRGYLEDEAAHAEEAFFNTILPADP
ALRYNVTWYVSSSPCAACADRITKTLSKTKNLRLLILVGRLFMWEEPEIQAALKKLK
EAGCKLRIMKPQDFEYIWQNFVEQESKAFQPWEDIQENFLYYEEKLAD

>G3TH88_LOXAF/52-221

(SEQ ID NO: 606)
FKFQFRNVEYSGRNKTFLCYVVEAQGKQVQASRGYLEDEAAHAEEAFFNTILPADP
ALRYNVTWYVSSSPCAACADRIIKTLNKTKNLRLLILVGRLFMWEEPEIQAALKKLK
EAGCKLRIMKPQDFDYVWQNFVEQESKAFEPWEDIQENFQYYEEKLAD

>H0WL56_OTOGA/52-221

(SEQ ID NO: 607)
FKFQFRNVEYSGRNKTFLCYVVEVQAKQVQASRGYLEDEAAHAEEAFFNTILPADP
ALKYNVTWYVSSSPCAACADHIIKTLNKTKNLRLLILVGRLFMWEEPEIQAALKKLK
EAGCKLRIMKPQDFEYIWQNFVEQESKAFEPWEDIQENFLYYEEKLAD

>L9KUD0_TUPCH/52-221

(SEQ ID NO: 608)
FKFQFRNVEYSGRNKTFLCYVVEAQAKQVQATRGYLEDEAAHAEEAFFNTILPADP
ALRYNVTWYVSSSPCAACADRIIKTLSKTKNLRLLILVGRLFMWEEPEIQAALRKMR
EAGCKLRIMKPQDFEYIWQNFVEQESKAFEPWEDIQENFLYYEEKLAD

>G319V7_CRIGR/52-221

(SEQ ID NO: 609)
FKFQFRNVEYSGRNKTFLCYVVEAQSKQVQATRGYLEDEGAHAEEAFFNTILPADPA
LKYNVTWYVSSSPCAACADRILKTLSKAKNLRLLILVGRLFMWEEPEVQAALKKLK
EAGCKLRIMKPQDFEYIWQNFVEQESKAFEPWEDIQENFLYYEEKLAD

>ABEC2_MOUSE/52-221

(SEQ ID NO: 610)
FKFQFRNVEYSGRNKTFLCYVVEVQSKQAQATQGYLEDEGAHAEEAFFNTILPADP
ALKYNVTWYVSSSPCAACADRILKTLSKTKNLRLLILVSRLFMWEEPEVQAALKKLK
EAGCKLRIMKPQDFEYIWQNFVEQESKAFEPWEDIQENFLYYEEKLAD

>F7AZT6_HORSE/52-221

(SEQ ID NO: 611)
FKFQFRNVEYSGRNKTFLCYVVEAQSKQVQASRGYLEDEAAHAEEAFFNTIMPADP
ALRYNVTWYVSSSPCAACADRIIKTLSKTKNLRLLILVGRLFMWEEPEIQAALKKLK
EAGCRLRIMKPQDFEYVWQNFVEQESKTFEPWEDIQENFLYYEEKLAD

>ABEC2_BOVIN/52-221

(SEQ ID NO: 612)
FKFQFRNVEYSGRNKTFLCYVVEAQSKQVQASRGYLEDETNHAEEAFFNSIMPTDPA
LRYMVTWYVSSSPCAACADRIVKTLNKTKNLRLLILVGRLFMWEEPEIQAALRKLKE
AGCRLRIMKPQDFEYIWQNFVEQESKAFEPWEDIQENFLYYEEKLAD

>S9WK76_CAMFR/64-233

(SEQ ID NO: 613)
FKFQFRNVEYSGRNKTFLCYVVEAQSKQVQATRGYLEDEAAHAEEAFFNTIMPTDP
ALRYIVTWYVSSSPCAACADRIIKTLNKTKNLRLLILVGRLFMWEEPEIQAALRKLKE
AGCKLRIMKPQDFEYVWQNFVEQESKAFEPWEDIQENFLYYEEKLAD

>F1RVM1_PIG/52-221

(SEQ ID NO: 614)
FKFQFRNVEYSGRNKTFLCYVIEAQSKQVQATRGYLEDEAAHAEEAFFNTILPADPA
VRYVVTWYVSSSPCAACADRIIKTLNKAKNLRLLILVGRLFMWEEPEIQAALRRLKE
AGCRLRIMKPQDFEYVWQNFVEQESKAFEPWEDIQENFLYYEEKLAD

>H0V2E8_CAVPO/56-225

(SEQ ID NO: 615)
FKFQFRNVEYSGRNKTFLCYVVEVQSKQVQASRGYLEDEAAHAEEAFFNSVLPADP
ALRYNVTWYVSSSPCAACADRIIKTLGKTKNLRLLILVGRLFMWEEPEIQAALRKLK
EAGCRLRIMKPQDFEYVWQNFVEQESKAFEPWEDIQENFLYYEDKLAD

>A0A091DJF3_FUKDA/59-228

(SEQ ID NO: 616)
FKFQFRNVEYSGRNKTFLCYVVEVQSKQVQASRGYLEDEAAHAEEAFFNTILPADPA
LRYSVTWYVSSSPCVACADRIVKTLGKTKNLRLLILVGRLFMWEEPEIQAALRKLKE
AGCRLRIMKPQDFEYVWQNFVEQESKAFEPWEDIQENFLYYEEKLAD

>G5BNG8_HETGA/56-225

(SEQ ID NO: 617)
FKFQFRNVEYSGRNKTFLCYVVEVQCKQVQASRGYLEDEAAHAEEAFFNTILPADP
ALRYNVTWYVSSSPCVACADRIIKTLAKTKNLRLLILVGRLFMWEEPEMQAALRKL
KEAGCRLRIMKPQDFEYVWQNFVEHESKAFEPWEDIKENFLYYEEKLAD

>G1PHZ8_MYOLU/58-227

-continued (SEQ ID NO: 618)
FKFQFRNVEYSGRNKTFLCYVIEVQDKQVQASRGYLEDETAHAEEAFFNTVVPTDPA
LRYNVTWYVSSSPCVACADRIIKMLSKTKNLRLLILVGRLFMWEEPAMQAALKKLK
EAGCRLRIMKPQDFEYIWQNFVEQESKAFEPWEDIQENFLYYEEKLAD

>G1U7Q3_RABIT/55-224

(SEQ ID NO: 619)
FKFQFRNVEYSGRNKTFLCYVVEVQGKQVQATRGYLEDEAAHAEEAFFNTILPADP
ALRYNVTWYVSSSPCAACADRIIRTLGKTKNLRLLILVGRLFMWEEPEIQAALKKLR
EAGCRLRIMKPQDFEYVWQNFVEQEAKAFEPWEDIQENFLYYEEKLAD

>M3W1K8_FELCA/61-230

(SEQ ID NO: 620)
FKFQFRNVEYSGRNKTFLCYVVEAQGKQVQASRGYLEDEAAHAEEAFFNTILPADP
AVRYNVTWYVSSSPCAACADRIVRTLGKTKNLRLLILVGRLFMWEEPDVQAALRRL
KEAGCRLRIMKPQDFEYVWQNFVEQESKAFEPWEDIQENFLYYEEKLAD

>G1LCS0_AILME/80-249

(SEQ ID NO: 621)
FKFQFRNVEYSGRNKTFLCYVVEAQGKQVQATRGYLEDEAAHAEEAFFNTILPADP
ALRYTVTWYVSSSPCAACADRIARTLGQTKNLRLLILAGRLLLWEEPDVRAALRRLA
EAGCRLRVMKPQDFEYVWQQFVEQEPKAFEPWEDIQENFLYYEEKLAD

>M3YQH9_MUSPF/61-230

(SEQ ID NO: 622)
FKFQFRNVEYSGRNKTFLCYVVETQAKQVQATRGYLEDETNHAEEAFFNTILPSDPA
LRYNVTWYVSSSPCAACADRILRTLGKTKNLRLLILVGRLFMWEEPEVQAALRKLK
EAGCRLRIMKPQDFEYVWQNFVEQESKAFEPWGDIQENFLYYEEKLAD

>E2RDL7_CANLF/52-221

(SEQ ID NO: 623)
FKFQFRNVEYSGRNKTFLCYVVEAQGKQVQASRGYLEDEAAHAEEAFFNTILPTDPA
LRYNVTWYVSSSPCAACADRIIRTLGKTKNLRLLILVGRLFMWEEPEVQAALRKLKE
AGCRLRIMKPQDFEYVWQNFVEQESKAFQPWEDIQENFLYYEEKLAD

>S7PKW6_MYOBR/115-291

(SEQ ID NO: 624)
FYFHFKNCPDHGRNGCYLCYEVKRQRGLPLVGTGVFENEPKHTEICFLNWFKTQQN
LSREEKYHVTWFMSWSPCFQCARQVVEFLKDHEYVQLSIFVARLYYSSRPEYQQGL
RSLQGAGAQVAIMTPDDFAYCRKVFVHDHKPFRYWKGIYINSCSLSKTLED

>S7NDM8_MYOBR/6-177

(SEQ ID NO: 625)
FNSNFKNLDGGCKSTFLCFEVEREDGSVLYQNGVFRNQHAELCFIEWFHEKVLCPDA
QYHVTWYISWSPCFECAEQVADFLNENENVDLSISAARLYLCEDEDEQGLQDLVAT
GAKVAMMAPEDFKYCWDNFVYNGWQFTYWKNVRRNYGRLQEKLDE

>S7PKW6_MYOBR/281-406

(SEQ ID NO: 626)
NSCSLSKTEDILRHAELCFLDWFREKVLCPDAQYHVTWYISWSPCFECAEQVADFLN
ENENVDLSISAARLYLCEDEDEQGLQDLVATGAKVAMMAPEDLTAKMVPDETPMF
DPS

>T0NHJ8_CAMFR/406-573

(SEQ ID NO: 627)
FSFHFKNLMFAGRNCTYLCYQVKREHCSPVPDKGVFQNEPCHAELCFLSWFNKRLS
PDECYHITWFMSWSPCFACTEQVAKFLEKNRNVRLSIFAARLYYFWQPAVQQGLRR
LHGVGACVGIMSYQDFKYCWENFVYNRMPFKPWEKQCENSKILVTKLEE

>F7DDE1_HORSE/12-179

(SEQ ID NO: 628)
FSFHFRNLEFAGRNCSYICYRVEGLSGSPGSEQGVFLNECRHAELCFLHWFRGRLSPD
EYYHVTWFISWSPCSNCAREVAEFLKRHRNVELSIFAARLYYWQRNKPDLRNLCSS
GAQLAIMFYQDFRYCWDNFVHNGREFIPWEKINVNSRLLATNLEE

>F7B644_HORSE/190-346

(SEQ ID NO: 629)
FSFHFRNLKFAGRKCSYLCYRVEGLSGSPGSEQGVFLNERRHAELCFLDWFRVRLSP
DEYYRVTWFISWSPCSYCAREVADFLKQYRNVKLSIFAARLYYCRDHAQGLRSLCSS
GAQLAIMFFWDFRYCWDNFVHNGRDFIPW

>F1MP61_BOVIN/29-199

(SEQ ID NO: 630)
FYFQFCNLLYARRNCSYICYKVERKYHSRAFDWGVFHNQRCHTELRFLSWFHAEKL
RPNERYHITWFMSWSPCMKCAKEVADFLGRHQNVTLSIFTARLYNFQEEGSRQGLL
RLSDQGAHVDIMSYQEFKYCWKKFVNSRRPFRPWKKLYRNYQRLVEELED

>L5K8J0_PTEAL/256-426

-continued (SEQ ID NO: 631)
FFFEFQNLLYAGRKSSYLCFQVERQHSSPVSDWGVFENQPYHAELCFLNWFRAEKLS
PYEHYDVTWFLSWSPCSTCAEEIAIFLSNHKNVRLSIFVSRIYYFWKPAFRQGLQELD
HLGVQLDAMSFDDFKYCWENFVDNGMPFRCWKKVHRNYKFVLRKLNE

>M3W3R0_FELCA/20-189

(SEQ ID NO: 632)
FRFHFPNLLYAGRKLCYLCFQVETDYFSCDSDRGVFRNKRCHAEQCFLSWFRDQYP
CRDEYYNVTWFLSWSPCPTCAEEVVEFLEEYRNLTLSIFTSRLYYFYHPNYQQGLRK
LWDAGVQLDIMSCDDFEHCWDNFVDHGMRFQRRNLLKDYDFLAAELQE

>G1LWD3_AILME/20-186

(SEQ ID NO: 633)
FFFQFPSLCYAGRKFCYLCFQVGRGHPSDWGVFRNKPYHAESCFLSWFRAQNLSPDE
DYHVTWFSSWSPCHTCADEVVEFLGQYRHVTLSIFAARLYYFWDPPFQNGLRRLQS
AGVRLDIMSFADYKRCWENFVDHGMRFQSRNLLRHRDLLASRLEN

>L9KTG4_TUPCH/9-177

(SEQ ID NO: 634)
FYFHFQNLLFAGRNTTFLCCRVDKERHGTVLVSGVFTHQYHAESHFLLWFQKNFLSL
DKDFQVTWYLSWSPCPACAKQVADFLAVHRNVSLTIFSARLYYFWDPEFRDGLHRL
FEKGARVAIMSPKDFENCWEGFVFNGRDFRPWDNMVENYQSLRITLQE

>I3M955_ICTTR/14-186

(SEQ ID NO: 635)
FLFHFRNLRWAGRNNTFLCYQVDRERDSTVIHRGVFKTQRLHAELCFLYWLHDYPL
FPDQHFHITWFISWSPCSDCAQQVAAFLASHSNLSLTVYTARLYYFWKHSYQEGLRA
LQREGARVEIMSIREFEHCWENFVYPGRPFRPWKNLFRNYYFQVKKLQK

>G3I2J2_CRIGR/40-210

(SEQ ID NO: 636)
FYFHFKNLRYALRKNTFLCYEVNRECNELVLCQGVFRKENLHAEVCFLYWFHTQVL
PPDEKYKITWYVSWSPCNECAEKVASFLDTHRNLSLAIFSSRLYYFWDPDYQDKLRR
LNQAGAQIAAMDFPEFEKCWNKFVDNGKSFRPWKRLKINFRFQDNKLRD

>F7EWS7_RAT/40-210

(SEQ ID NO: 637)
FYFHFKNVRYAGRKNNFLCYEVNGDCALPVLRQGVFRKQHIHAELCFIYWFHDKVL
SPMEEFKVTWYMSWSPCSKCAEQVARFLAAHRNLSLAIFSSRLYYYLNPNYQQKLC
RLIQEGVHVAAMDLPEFKKCWNKFVDNGQPFRPWMRLRINFSFYDCKLQE

>ABEC3_RAT/26-195

(SEQ ID NO: 638)
FKFHFKNLRYADRKDTFLCYEVTRDCDSPVLHHGVFKNKNIHAEICFLYWFHDKVL
SPREEFKITWYMSWSPCFECAEQVLRFLATHHNLSLDIFSSRLYNIRDPENQQNLCRL
VQEGAQVAAMDLYEFKKCWKKFVDNGRRFRPWKKLLTNFRYQDSKLQE

>ABEC3_MOUSE/26-195

(SEQ ID NO: 639)
FKFHFKNLGYAGRKDTFLCYEVTRDCDSPVLHHGVFKNKNIHAEICFLYWFHDKVL
SPREEFKITWYMSWSPCFECAEQIVRFLATHHNLSLDIFSSRLYNVQDPETQQNLCRL
VQEGAQVAAMDLYEFKKCWKKFVDNGRRFRPWKRLLTNFRYQDSKLQE

>F6XHA6_MACMU/213-383

(SEQ ID NO: 640)
FYFHFENLQKAGRNETWLCFAVEIKQHSTVWKTGVFRNQHCHAERCFLSWFCDNTL
SPKKNYQVTWYISWSPCPECAGEVAEFLATHSNVKLTIYTARLYYFWDTDYQEGLR
SLSEEGASMEIMGYEDFKYCWENFVYNGEPFKPWKGINTNFRFLERRLWK

>A0A096NK50_PAPAN/213-383

(SEQ ID NO: 641)
FYFHFKNLRTADRNETWLCFAVEIKQRSTVWRTGVFRNQHCHAERCFLSWFRDNPL
SPKKNYQVTWYTSWSPCPECAGEVAEFLARYSNVQLTIYTARLYYFWDTDYQEGLR
SLSEEGASVEIMGYEDFKYCWENFVCDGEPFKPWKGINTNFRFLERHLRK

>G3RD21_GORGO/200-370

(SEQ ID NO: 642)
FYFHFKNLRKAGRNESWLCFTMEVKHHSPVWKRGVFRNQHCHAERCFLSWFCDDI
LSPNTNYQVTWYTSWSPCPECAGEVAEFLARHSNVNLTIFTARLYYFWDTDYQEGL
RSLNQEGASVKIMGYKDFKYCWENFVYNDEPFKPWKGLKYNFLFLDSKLQE

>A0A096NK49_PAPAN/167-338

(SEQ ID NO: 643)
FYFHFKNLRKAGRNESLLCFTMEIKQCSTVWKRGVFRNQHCHAERCFLSWFCEDILS
PNTDYQVTWYTSWSPCLDCAGEVAEFLARHSNVKLAIFAARLYYFWDTDYQQGLR
SLSEEGASVQIMGYEDFKYCWENFVYNDEPFKPWKGLKYNFLFLDSKLQE

>A0A0D9R238_CHLSB/197-367

```
                                                    (SEQ ID NO: 644)
FYFHFKNLRKAGRNESWLCFTMEIKQCSTVWKRGVFRNQRCHAERCFLSWFCEDIL
SPNTDYQVTWYTSWSPCLDCAGEVAEFLARHSNVKLTIYTARLYYFWHTDYQQGL
RSLSEEGASVEIMGYEDFKCCWENFVYNDEPFKPWKGLKYNFLFLDSKLQE

>G3RRB4_GORGO/39-209
                                                    (SEQ ID NO: 645)
FYFQFKNLWEADRNETWLCFTVEGKRRSVVWKTGVFRNQHCHAERCFLSWFCDDI
LSPNTNYQVTWYTSWSPCPECAGEVAEFLARHSNVNLTIFTARLYYFWDTDYQEGL
RSLNQEGASVKIMGYKDFKYCWENFVYNDEPFKPWKGLKYNFLFLDSKLQE

>G3RUE8_GORGO/17-187
                                                    (SEQ ID NO: 646)
FYFQFKNLWEADRNETWLCFTVEGKRRSVVWKTGVFRNQHCHAERCFLSWFCDDI
LSPNTNYEVTWYTSWSPCPECAGKVAEFLARHSNVNLTIFTARLCYFWDTDYQEGL
RSLNQEGASVKIMGYKDFVSCWKNFVYSDEPFKPWKGLQTNFRLLKRRLRE

>Q6ICH2_HUMAN/17-199
                                                    (SEQ ID NO: 647)
FYDNFENEPILGRSYTWLCYEVKIRGRSNLWDTGVFRGEHCHAERCFLSWFCDDILS
PNTNYEVTWYTSWSPCPECAGEVAEFLARHSNVNLTIFTARLCYFWDTDYQEGLCS
LSQEGASVKIMGYKDFVSCWKNFVYSDEPFKPWKGLQTNFRLLKRRLRE

>ABC3D_HUMAN/213-383
                                                    (SEQ ID NO: 648)
FYFHFKNLLKAGRNESWLCFTMEVKHHSAVRKRGVFRNQHCHAERCFLSWFCDDIL
SPNTNYEVTWYTSWSPCPECAGEVAEFLARHSNVNLTIFTARLCYFWDTDYQEGLCS
LSQEGASVKIMGYKDFVSCWKNFVYSDEPFKPWKGLQTNFRLLKRRLRE

>ABC3C_GORGO/17-187
                                                    (SEQ ID NO: 649)
FYFQFKNLWEADRNETWLCFTVEGKRRSVVWKTGVFRNQHCHAERCFLSWFCDDI
LSPNTNYQVTWYTSWSPCPECAGEVAEFLARHSNVNLTIFTARLYYFQDTDYQEGLR
SLSQEGVAVKIMDYKDFKYCWENFVYNDEPFKPWKGLKYNFRFLKRRLQE

>ABC3C_HUMAN/17-187
                                                    (SEQ ID NO: 650)
FYFQFKNLWEADRNETWLCFTVEGKRRSVVWKTGVFRNQHCHAERCFLSWFCDDI
LSPNTKYQVTWYTSWSPCPDCAGEVAEFLARHSNVNLTIFTARLYYFQYPCYQEGL
RSLSQEGVAVEIMDYEDFKYCWENFVYNNEPFKPWKGLKTNFRLLKRRLRE

>H2P4E8_PONAB/17-187
                                                    (SEQ ID NO: 651)
FYFQFKNLWEADRNETWLCFTVEVKHHTVVWKRGVFRNQHCHAESCFLSWFCNNI
LSPNTNYRVTWYASWSPCPECAGEVAKFLARHSNVKLTIFTARLYYFQNPYYQQGL
RRLSQEGVAVGIMDYEDFKDCWENFVYSDEPFKPWKGINTNFRLLKKRLRE

>A0A096NK46_PAPAN/17-187
                                                    (SEQ ID NO: 652)
FYFQFKNLWEANRNETWLCFTVEVKQRSTVWERGVFQNQHCHAERCFLSWFCEDIL
SPNTDYQVTWYTSWSPCPECAGEVAEFLARHNNVMLTIYTARLYYSQDPNYQQGLR
SLSEKGVSVKIMDYEDFKYCWENFVYNDEPFKPWKGLKYNFLFLDSKLQE

>A0A0D9R255_CHLSB/17-187
                                                    (SEQ ID NO: 653)
FYFQFKNLREANRNETWLCFTVEGRHHLTVWKTGVFRNQHCHAEKCFLSWFCKNIL
SPNTDYQVTWYTSWSPCPECAREVAKFLARHNNVMLTIYTARLYYSQCPNYQQGLR
SLSEKGVSVEIMDYEDFKYCWQNFVYDGEPFKPWKGLKTSFRFLKRCLRE

>F6XHB3_MACMU/37-207
                                                    (SEQ ID NO: 654)
FYFQFKNLREANRNETWLCFAVEIKQRSTVLKTGVFRNQHCHAERCFLSWFCEDILS
PNTDYQVTWYTSWSPCLDCAGEVAKFLARHNNVMLTIYTARLYYSQYPNYQQGLR
SLSEKGVSVKIMDYEDFKYCWEKFVYDGEPFKPWKGLKTSFRFLKRRLRE

>H0VE76_CAVPO/1-121
                                                    (SEQ ID NO: 655)
LHAELSFLSWFHDTELSFDENYKVTWYMSWSPCPECAKEIVTFLDNHHNVTLTIYVA
RLYYHWNPTYKEGLRALVQGGTRLYTMAFPEFEDCWSLFVNETFRPWENFHKCCSL
QDKTLQK

>G5AYU4_HETGA/17-183
                                                    (SEQ ID NO: 656)
FYFHFENLPYAGRNKTFLCYEVKRRDNKLHKGVVQNQLSRTELSFISCFHATELCLD
ETYKVTWYISWSPCVECAEEIVKFLANHRNVPLTVFIARLYYYREHTFKEGLQALDN
GGVQMHMMCLQDFKDCWSLFVSETFRPWKGLRKYYLFQNKTLKQ

>H0VZF7_CAVPO/17-183
```

(SEQ ID NO: 657)
FYFHFENLPNAGRHKTFLCFEVKNNELHKGFFLNQLHAELRFLSWLHDTCLCPYEYY
QVTWYMSWSPCVECAEELTTFLAGHRNVTLTIYVARLYYHQFPVYKNRLQALIKKG
ATVKVMFFRDFLYCWRRFVYNFKRFYDWPNLHKNSLHYYKTLQH

>G5AYU3_HETGA/12-181

(SEQ ID NO: 658)
FYFHFENLPDPGWNKTFLCYEVKRQDQKLRKGVFQNQPLHAELRFLSWFHDTLLCP
LGSYQVTLYVSWSPCSECAEELTTFLAGHRNVTMTIYVAQLYYCNKSPNREGLKILI
AEDARLRVMFYDEFLYCWRNFVKNYNNFDPWSLLDENSRYHNRILQN

>G5AYU5_HETGA/20-189

(SEQ ID NO: 659)
FRFYFRNLRCAGRNKTFLCYEVKRRDNKLHKGVVLNQPLHAELRFLSWFHDTLLCP
LGSYQVTLYVSWSPCSECAEELTTFLAGHRNVTMTIYVAQLYYCNKSPNREGLKILI
AEDARLRVMFYDEFLYCWRNFVKNYNNFDPWSLLDENSRYHNRILQN

>A0A091EM42_FUKDA/42-211

(SEQ ID NO: 660)
FKFHFENLPNPGWHKTFLCYTIESQKNRLRNGVFQNQRLHAELRFLSWFHDNWLCP
GNSYRVTFYMSWSPCSECAEELTTFLAGHRNVTLTIFFSKLYYCDDSSNREGLKTLA
AGGARLFVMFDTDFSYCWTNFVNCYNYFEPWPLLDDNSKYCNRILQK

>A0A091EM42_FUKDA/225-394

(SEQ ID NO: 661)
FYFHFNNLCFAGRNKTFLCYTIESKKNRLRNGVFQNQRLHAELRFLSWFHDNWLCP
GNSYQVTLYMSWSPCSECAEELTTFLAGHRNVTLTIFFSKLYCCDDSPHREGLKTLA
AGGARLFVMFDTDFSYCWTNFVNCYNYFEPWPLLDDNSKYYKSILQK

>H0XYD2_OTOGA/17-183

(SEQ ID NO: 662)
FNCHFNNRPYLRRNDTWLCFEVKTSSNSPGFYSGVFQNQPWHTELCILTWARPMLS
HHHFYQITWYMSWSPCANCAWQVAAFLATHENVSLTIYTAHIYYMWRQDYRQGM
LRMIEEGTRVYIMFSKEFQHCWENFVDHGMCWNRVKKNYEFLVTQLNE

>H0XYD2_OTOGA/192-348

(SEQ ID NO: 663)
FYNQFNNTPVPGRTDTWLCFEVKNNSNSPGFHRGSSENRHAEVGFLTWFQKEMPPN
HHYEVTWYISWSPCVHCAWHVVNFLTSNPNMTLTIFAARLYYIYHPEEGTKVHIVSL
KEFKYCWAKLVYNGMRFMPWYQFNENYQLLVTQLKK

>A0A096N7U5_PAPAN/17-167

(SEQ ID NO: 664)
FYYNFENRSVLGWNTTWLCHKVKTKDPSKLLDTRIFGGQHHPEMRFLDWFCKYISR
SPCPEYAEKVAEFLVKNGKVTLTIFVAHLYYFWEPDYQNGVRPHASMTIMNYDEFQ
HCWDKFVYNRMLFDPWKQLNTNYALLHSMLGE

>H9KW44_CALJA/2-132

(SEQ ID NO: 665)
QHHPEMRFLHWFRKWKLHSDQEYEVTWFVSWSPCPVCARNVAEFLTEDGKVTLTIF
VARLYYFWIPHYREELRRLCQPRATMKIMSYGEFQHCWDKFVDNRLYKPWNKLPK
HYTLLHITLGE

>ABC3G_PAPAN/17-191

(SEQ ID NO: 666)
FFYNFNNRPILRRNTVWLCYEVKTRGPSMPWDAKIFRGQKYHPEMRFLHWFRKWR
QLHRDQEYEVTWYVSWSPCTGCANSVATFLAEDPKVTLTIFVARLYYFWKPDYQEA
LRVLCQPHATMKIMNYNEFQHCWNKFVRGREPFEPWENLPKHYTLLHATLGE

>G7PFK4_MACFA/13-187

(SEQ ID NO: 667)
FFYNFNNRPILRRNTVWLCYEVKTRGPSVPWGTKIFRGQKYHPEMRFLRWFHKWRQ
LHHDQEYKVTWYVSWSPCTRCANSVATFLAKDPKVTLTIFVARLYYFWKPDYQQA
LRILCQPHATMKIMNYNEFQDCWNKFVDGGKPFKPRNNLPKHYTLLQATLGE

>A0A0D9R229_CHLSB/28-202

(SEQ ID NO: 668)
FVYYFNNRPILGRNIVWLCCEVKTKDPSGPLDANIFQGEKDHPEMKFLHWFRKWRQ
LHRDQEYEVTWYVSWSPCTRCANSVATFLAEDPKVTLTIFVARLYYFWKPHYQEAL
RILCQPHATMKIMNYNEFQCWNEFVDGGKPFKPRKNLPKHYTLLHATLGE

>ABC3G_MACMU/10-184

(SEQ ID NO: 669)
FVSNFNNRPILGLNTVWLCCEVKTKDPSGPLDAKIFQGKKYHPEMRFLRWFHKWRQ
LHHDQEYKVTWYVSWSPCTRCANSVATFLAKDPKVTLTIFVARLYYFWKPDYQQA
LRILCQPHATMKIMNYNEFQDCWNKFVDGGKPFKPRNNLPKHYTLLQATLGE

>H2P4E9_PONAB/31-202

-continued (SEQ ID NO: 670)
FSYNFKNRPILRRNTVWLCYEVKTKGPSRPLDAKIFRGQKNHPEMRFFHWFSKWRT
LHRDQECEVTWYMSWSPCTKCTRNVATFLAEDPKVTLTIFVARLYYFWDPDYQEAL
RSLCRPRANMKIMNYDEFQHCWNKFVYSRELFEPWNNLPKYYIPLHKV

>ABC3G_HUMAN/17-190

(SEQ ID NO: 671)
FSYNFYNRPILRRNTVWLCYEVKTKGPSRPLDAKIFRGQKYHPEMRFFHWFSKWRK
LHRDQEYEVTWYISWSPCTKCTRDMATFLAEDPKVTLTIFVARLYYFWDPDYQEAL
RSLCQPRATMKIMNYDEFQHCWSKFVYSRELFEPWNNLPKYYILLHIMLG

>ABC3G_GORGO/17-190

(SEQ ID NO: 672)
FSYNFNNRPILRRNTVWLCYEVKTKDPSRPLDAKIFRGQKYHPEMRFFHWFSKWRK
LHRDQEYEVTWYISWSPCTKCTRNVATFLAEDPKVTLTIFVARLYYFWDQDYQEAL
RSLCQPRATMKIMNYDEFQHCWSKFVYSRELFEPWNNLPKYYMLLHIMLG

>G3RD21_GORGO/17-186

(SEQ ID NO: 673)
FSYNFNNRPILRRNTVWLCYEVKTKGPSRPLDAKIFRGQQYHAEMCFLSWFCGNQLP
AYKCFQITCFVSWTPCPDCVAKLAEFLAEHPNVTLTISAARLYYYWERDYRRALRRL
RQAGARVKIMDDEEFAYCWENFVYSGQPFMPWHKFDDNYAFLHRTLKE

>ABC3F_HUMAN/17-186

(SEQ ID NO: 674)
FSYNFYNRPILRRNTVWLCYEVKTKGPSRPLDAKIFRGQEHHAEMCFLSWFCGNQLP
AYKCFQITWFVSWTPCPDCVAKLAEFLAEHPNVTLTISAARLYYYWERDYRRALCR
LSQAGARVKIMDDEEFAYCWENFVYSGQPFMPWYKFDDNYAFLHRTLKE

>A0A096NK49_PAPAN/1-153

(SEQ ID NO: 675)
WFCFEVKTRGPSMPWDAKIFRGQQYHAEMCFLSRFCGNQLPAYKRFQITWFVSWTP
CPDCVVKVAEFLAEHPNVTLTISAARLYYYWETDYRRALCRLRQAGAHVKIMDNEE
FAYCWENFVYNGQSFMPWDKFDDNYAFLHCKLKE

>A0A096NK45_PAPAN/17-187

(SEQ ID NO: 676)
FYYHFENKPILGRSYTWLCYEVKIKDPSKLWYTGVFRGQEHHAEMCFLSRFCGNQL
PAYKRFQITWFVSWNPCPDCVAKVIEFLAEHPNVTLTISTARLYYYWGRDWQRALC
RLRQAGARVKIMDYEEFAYCWENFVYNGQSFMPWDKFDDNYAFLHCKLKE

>F7FXJ2_MACMU/2-130

(SEQ ID NO: 677)
EHHAEMCFLSRFCGNQLPAYKRFQITWFVSWNPCPDCVAKVIEFLAEHPNVTLTIST
ARLYYYWGRDWQRALCRLRQAGARVKIMDYEEFAYCWENFVYNDQSFMPWYKF
NDNYAFLHRMLKE

>A0A0D9R238_CHLSB/17-183

(SEQ ID NO: 678)
FYYNFENEPILGRRYTWLCYEVKIKDPSKLWDTGVFPGQQYHAEMYFLSWFCGNQL
PAYKHFQITWFVSWNPCPDCVAKVTEFLAEHRNVTLTISAARLYYYWGKDWRRAL
CRLHQAGARVKIMDDEEFAYCWENCVYNGQPFMPWDKFDDNYAFLHLKLKE

>A0A096NK50_PAPAN/17-199

(SEQ ID NO: 679)
FDYNFENEPILGRSYTWLCYEVKIEDPSKLWDTGVFQGQQYHAEMCFLSRFCGNQLP
AYKRFQITWFVSWNPCPDCVAKVTEFLAEHPNVTLTISAARLYYYWGRDWRRALRR
LHQAGARVKIMDYEEFAYCWENFVYNGQSFMPWDKFDDNYAFLHCKLKD

>F6XHA6_MACMU/17-199

(SEQ ID NO: 680)
FNYNFENEPILGRSYTWLCYEVKIKDPSKLWDTGVFRGQQYHAEMCFLSWFCGNQL
PAYKRFQITWFVSWNPCPDCVAKVTEFLAEHPNVTLTISAARLYYYWGKDWRRALR
RLHQAGALVKIMDYEEFAYCWENFVYNGQSFMPWDKFDDNYASLHCKLKE

>A0A0D9R289_CHLSB/17-187

(SEQ ID NO: 681)
FYYHFENEPILGRSYTWLCYEVKIKDPSKLWDTGVFRGQEHHAEMCFLSWFCGNQL
PAHKRFQITWFVSWTPCPDCVAKVAEFLAEYPNVTLTISAARLYYYWETDYRRALC
RLRQAGARVKIMDYEEFAYCWENCVYNGQPFMPWYKFDDNYAFLHHKLKE

>G1RYY7_NOMLE/17-187

(SEQ ID NO: 682)
FYYNFENEPILRRSYTWLCYEVKIKDPSKLWDTGVFRGQEYHAEMCFLSWFCGNQL
PAYKRFQITWFVSWTPCPDCVAKVAVFLAEHPNVTLTISAARLYYYWEKDWQRALC
RLSQAGARVKIMDYEEFEYCWENFVYNGEPFMPWYKFDDNYAFLHHTLKE

>H2P4E7_PONAB/17-187

-continued

>H2QLP5_PANTR/17-187
(SEQ ID NO: 683)
FYYDFENEPILRRNYTWLCYEVKIKDPSKLWDTGVFRGQEHHAEMCFLSWFCGNQL
SAYERFQITWFVSWTPCPDCVAKLAEFLAEHPNVTLTVSAARLYYYWERGYRRALR
RLRQAGAHVKIMDYEEFAYCWENFVYNGQPFMPWYKFDDNYAFLHHTLKE

>H2QLP5_PANTR/17-187
(SEQ ID NO: 684)
FYYNFENEPILGRSYTWLCYEVKIRGHSNLWDTGVFRGQEHHAEMCFLSWFCGNQL
SAYKCFQITWFVSWTPCPDCVAKLAKFLAEHPNVTLTISAARLYYYWERDYRRALC
RLSQAGARVKIMDDEEFAYCWENFVYNGQPFMPWYKFDDNYAFLHRTLKE

>ABC3D_HUMAN/17-199
(SEQ ID NO: 685)
FYDNFENEPILGRSYTWLCYEVKIRGRSNLWDTGVFRGPENHAEMCFLSWFCGNRL
PANRRFQITWFVSWNPCLPCVVKVTKFLAEHPNVTLTISAARLYYYRDRDWRWVLL
RLHKAGARVKIMDYEDFAYCWENFVCNGQPFMPWYKFDDNYASLHRTLKE

>ABC3B_HUMAN/17-187
(SEQ ID NO: 686)
FYDNFENEPILGRSYTWLCYEVKIRGRSNLWDTGVFRGQQYHAEMCFLSWFCGNQL
PAYKCFQITWFVSWTPCPDCVAKLAEFLSEHPNVTLTISAARLYYYWERDYRRALCR
LSQAGARVTIMDYEEFAYCWENFVYNGQQFMPWYKFDENYAFLHRTLKE

>G3SFT2_GORGO/17-187
(SEQ ID NO: 687)
FYDNFENEPILGRSYNWLCYEVKIRGRSNLWNTGVFRGQEHHAEMCFLSWFCGNQL
PAYKCFQITWFVSWTPCPDCVAKLAEFLAEYPNVTLTISTARLYYYWERDYRRALCR
LSQAGARMKIMDYEECAYCWENFVYKGQQFMPWYKFDENYAFLHHTLKE

Sequences 6. Sequences of Claims:
NLS Sequences:

(SEQ ID NO: 1)
KRTADGSEFESPKKKRKV (SEQ ID NO: 2)
KRTADGSEFEPKKKRKV

Cas9 for BE4 max, AncBE4 max and ABEmax:

Cas9 for BE4max, AncBE4max and ABEmax:
(SEQ ID NO: 3)
DKKYSIGLAIGTNSVGWAVITDEYKVPSKKFKVLGNTDRHSIKKNLIG
ALLFDSGETAEATRLKRTARRRYTRRKNRICYLQEIFSNEMAKVDDSFFHRLEESFLV
EEDKKHERHPIFGNIVDEVAYHEKYPTIYHLRKKLVDSTDKADLRLIYLALAHMIKFR
GHFLIEGDLNPDNSDVDKLFIQLVQTYNQLFEENPINASGVDAKAILSARLSKSRRLE
NLIAQLPGEKKNGLFGNLIALSLGLTPNFKSNFDLAEDAKLQLSKDTYDDDLDNLLA
QIGDQYADLFLAAKNLSDAILLSDILRVNTEITKAPLSASMIKRYDEHHQDLTLLKAL
VRQQLPEKYKEIFFDQSKNGYAGYIDGGASQEEFYKFIKPILEKMDGTEELLVKLNRE
DLLRKQRTFDNGSIPHQIHLGELHAILRRQEDFYPFLKDNREKIEKILTFRIPYYVGPLA
RGNSRFAWMTRKSEETITPWNFEEVVDKGASAQSFIERMTNFDKNLPNEKVLPKHSL
LYEYFTVYNELTKVKYVTEGMRKPAFLSGEQKKAIVDLLFKTNRKVTVKQLKEDYF
KKIECFDSVEISGVEDRFNASLGTYHDLLKIIKDKDFLDNEENEDILEDIVLTLTLFEDR
EMIEERLKTYAHLFDDKVMKQLKRRRYTGWGRLSRKLINGIRDKQSGKTILDFLKSD
GFANRNFMQLIHDDSLTFKEDIQKAQVSGQGDSLHEHIANLAGSPAIKKGILQTVKV
VDELVKVMGRHKPENIVIEMARENQTTQKGQKNSRERMKRIEEGIKELGSQILKEHP
VENTQLQNEKLYLYYLQNGRDMYVDQELDINRLSDYDVDHIVPQSFLKDDSIDNKV
LTRSDKNRGKSDNVPSEEVVKKMKNYWRQLLNAKLITQRKFDNLTKAERGGLSELD
KAGFIKRQLVETRQITKHVAQILDSRMNTKYDENDKLIREVKVITLKSKLVSDFRKDF
QFYKVREINNYHHAHDAYLNAVVGTALIKKYPKLESEFVYGDYKVYDVRKMIAKSE

QEIGKATAKYFFYSNIMNFFKTEITLANGEIRKRPLIETNGETGEIVWDKGRDFATVR

KVLSMPQVNIVKKTEVQTGGFSKESILPKRNSDKLIARKKDWDPKKYGGFDSPTVAY

SVLVVAKVEKGKSKKLKSVKELLGITIMERSSFEKNPIDFLEAKGYKEVKKDLIIKLP

KYSLFELENGRKRMLASAGELQKGNELALPSKYVNFLYLASHYEKLKGSPEDNEQK

QLFVEQHKYLDEIIEQISEFSKRVILADANLDKVLSAYNKHRDKPIREQAENIIHLFT

LTNLGAPAAFKYFDTTIDRKRYTSTKEVLDATLIHQSITGLYETRIDLSQLGGD rAPOBEC:
(SEQ ID NO: 4)
SSETGPVAVDPTLRRRIEPHEFEVFFDPRELRKETCLLYEINWGGRHSI

WRHTSQNTNKHVEVNFIEKFTTERYFCPNTRCSITWFLSWSPCGECSRAITEFLSRYP

HVTLFIYIARLYHHADPRNRQGLRDLISSGVTIQIMTEQESGYCWRNFVNYSPSNEAH

WPRYPHLWVRLYVLELYCIILGLPPCLNILRRKQPQLTFFTIALQSCHYQRLPPHILWA

TGLK

Anc689 APOBEC:
(SEQ ID NO: 5)
SSETGPVAVDPTLRRRIEPHEFEVFFDPRELRKETCLLYEIKWGTSHKI

WRHSSKNTTKHVEVNFIEKFTSERHFCPSTSCSITWFLSWSPCGECSKAITEFLSQHPN

VTLVIYVARLYHHMDQQNRQGLRDLVNSGVTIQIMTAPEYDYCWRNFVNYPPGKE

AHWPRYPPLWMKLYALELHAGILGLPPCLNILRRKQPQLTFFTIALQSCHYQRLPPHI

LWATGLK

Anc687 APOBEC:
(SEQ ID NO: 6)
SSETGPVAVDPTLRRRIEPHEFEVFFDPRELRKEACLLYEIKWGTSHKI

WRNSGKNTTKHVEVNFIEKFTSERHFCPSISCSITWFLSWSPCWECSKAIREFLSQHPN

VTLVIYVARLFQHMDQQNRQGLRDLVNSGVTIQIMTASEYDHCWRNFVNYPPGKEA

HWPRYPPLWMKLYALELHAGILGLPPCLNILRRKQPQLTFFTIALQSCHYQRLPPHIL

WATGLK

Anc686 APOBEC:
(SEQ ID NO: 7)
SSETGPVAVDPTLRRRIEPEFFNRNYDPRELRKETYLLYEIKWGKESKI

WRHTSNNRTQHAEVNFLENFFNELYFNPSTHCSITWFLSWSPCGECSKAIVEFLKEHP

NVNLEIYVARLYLCEDERNRQGLRDLVNSGVTIRIMNLPDYNYCWRTFVSHQGGDE

DYWPRHFAPWVRLYVLELYCIILGLPPCLNILRRKQPQLTFFTIALQSCHYQRLPPHIL

WATGLK

Anc655 APOBEC:
(SEQ ID NO: 8)
SSETGPVAVDPTLRRRIEPFYFQFNNDPRACRRKTYLCYELKQDGSTW

VWKRTLHNKGRHAEICFLEKISSLEKLDPAQHYRITWYMSWSPCSNCAQKIVDFLKE

HPHVNLRIYVARLYYHEEERYQEGLRNLRRSGVSIRVMDLPDFEHCWETFVDNGGG

PFQPWPGLEELNSKQLSRRLQAGILGLPPCLNILRRKQPQLTFFTIALQSCHYQRLPPH

ILWATGLK

Anc733 APOBEC:
(SEQ ID NO: 9)
SSETGPVAVDPTLRRRIEPFHFQFNNDPRAYRRKTYLCYELKQDGSTW

VLDRTLRNKGRHAEICFLDKINSWERLDPAQHYRVTWYMSWSPCSNCAQQVVDFL

```
KEHPHVNLRIFAARLYYHEQRRYQEGLRSLRGSGVPVAVMTLPDFEHCWETFVDHG

GRPFQPWDGLEELNSRSLSRRLQAGILGLPPCLNILRRKQPQLTFFTIALQSCHYQRLP

PHILWATGLK
```

UGI domain:

(SEQ ID NO: 10)
```
MTNLSDIIEKETGKQLVIQESILMLPEEVEEVIGNKPESDILVHTAYDES

TDENVMLLTSDAPEYKPWALVIQDSNGENKIKML
```

32 a.a. linker:

(SEQ ID NO: 11)
```
SGGSSGGSSGSETPGTSESATPESSGGSSGGS
```

BE4max:

(SEQ ID NO: 12)
```
MKRTADGSEFESPKKKRKVSSETGPVAVDPTLRRRIEPHEFEVFFDPRE

LRKETCLLYEINWGGRHSIWRHTSQNTNKHVEVNFIEKFTTERYFCPNTRCSITWFLS

WSPCGECSRAITEFLSRYPHVTLFIYIARLYHHADPRNRQGLRDLISSGVTIQIMTEQE

SGYCWRNFVNYSPSNEAHWPRYPHLWVRLYVLELYCIILGLPPCLNILRRKQPQLTF

FTIALQSCHYQRLPPHILWATGLKSGGSSGGSSGSETPGTSESATPESSGGSSGGSDKK

YSIGLAIGTNSVGWAVITDEYKVPSKKFKVLGNTDRHSIKKNLIGALLFDSGETAEAT

RLKRTARRRYTRRKNRICYLQEIFSNEMAKVDDSFFHRLEESFLVEEDKKHERHPIFG

NIVDEVAYHEKYPTIYHLRKKLVDSTDKADLRLIYLALAHMIKFRGHFLIEGDLNPD

NSDVDKLFIQLVQTYNQLFEENPINASGVDAKAILSARLSKSRRLENLIAQLPGEKKN

GLFGNLIALSLGLTPNFKSNFDLAEDAKLQLSKDTYDDDLDNLLAQIGDQYADLFLA

AKNLSDAILLSDILRVNTEITKAPLSASMIKRYDEHHQDLTLLKALVRQQLPEKYKEIF

FDQSKNGYAGYIDGGASQEEFYKFIKPILEKMDGTEELLVKLNREDLLRKQRTFDNG

SIPHQIHLGELHAILRRQEDFYPFLKDNREKIEKILTFRIPYYVGPLARGNSRFAWMTR

KSEETITPWNFEEVVDKGASAQSFIERMTNFDKNLPNEKVLPKHSLLYEYFTVYNELT

KVKYVTEGMRKPAFLSGEQKKAIVDLLFKTNRKVTVKQLKEDYFKKIECFDSVEISG

VEDRFNASLGTYHDLLKIIKDKDFLDNEENEDILEDIVLTLTLFEDREMIEERLKTYAH

LFDDKVMKQLKRRRYTGWGRLSRKLINGIRDKQSGKTILDFLKSDGFANRNFMQLIH

DDSLTFKEDIQKAQVSGQGDSLHEHIANLAGSPAIKKGILQTVKVVDELVKVMGRHK

PENIVIEMARENQTTQKGQKNSRERMKRIEEGIKELGSQILKEHPVENTQLQNEKLYL

YYLQNGRDMYVDQELDINRLSDYDVDHIVPQSFLKDDSIDNKVLTRSDKNRGKSDN

VPSEEVVKKMKNYWRQLLNAKLITQRKFDNLTKAERGGLSELDKAGFIKRQLVETR

QITKHVAQILDSRMNTKYDENDKLIREVKVITLKSKLVSDFRKDFQFYKVREINNYH

HAHDAYLNAVVGTALIKKYPKLESEFVYGDYKVYDVRKMIAKSEQEIGKATAKYFF

YSNIMNFFKTEITLANGEIRKRPLIETNGETGEIVWDKGRDFATVRKVLSMPQVNIVK

KTEVQTGGFSKESILPKRNSDKLIARKKDWDPKKYGGFDSPTVAYSVLVVAKVEKG

KSKKLKSVKELLGITIMERSSFEKNPIDFLEAKGYKEVKKDLIIKLPKYSLFELENGRK

RMLASAGELQKGNELALPSKYVNFLYLASHYEKLKGSPEDNEQKQLFVEQHKHYLD

EIIEQISEFSKRVILADANLDKVLSAYNKHRDKPIREQAENIIHLFTLTNLGAPAAFKYF

DTTIDRKRYTSTKEVLDATLIHQSITGLYETRIDLSQLGGDSGGSGGSGGSTNLSDIIEK

ETGKQLVIQESILMLPEEVEEVIGNKPESDILVHTAYDESTDENVMLLTSDAPEYKPW

ALVIQDSNGENKIKMLSGGSGGSGGSTNLSDIIEKETGKQLVIQESILMLPEEVEEVIG
```

-continued

NKPESDILVHTAYDESTDENVMLLTSDAPEYKPWALVIQDSNGENKIKMLSGGSKRT

ADGSEFEPKKKRKV

AncBE4max 689: (SEQ ID NO: 13)
MKRTADGSEFESPKKKRKVSSETGPVAVDPTLRRRIEPHEFEVFFDPRE

LRKETCLLYEIKWGTSHKIWRHSSKNTTKHVEVNFIEKFTSERHFCPSTSCSITWFLS

WSPCGECSKAITEFLSQHPNVTLVIYVARLYHHMDQQNRQGLRDLVNSGVTIQIMTA

PEYDYCWRNFVNYPPGKEAHWPRYPPLWMKLYALELHAGILGLPPCLNILRRKQPQ

LTFFTIALQSCHYQRLPPHILWATGLKSGGSSGGSSGSETPGTSESATPESSGGSSGGS

DKKYSIGLAIGTNSVGWAVITDEYKVPSKKFKVLGNTDRHSIKKNLIGALLFDSGETA

EATRLKRTARRRYTRRKNRICYLQEIFSNEMAKVDDSFFHRLEESFLVEEDKKHERH

PIFGNIVDEVAYHEKYPTIYHLRKKLVDSTDKADLRLIYLALAHMIKFRGHFLIEGDL

NPDNSDVDKLFIQLVQTYNQLFEENPINASGVDAKAILSARLSKSRRLENLIAQLPGE

KKNGLFGNLIALSLGLTPNFKSNFDLAEDAKLQLSKDTYDDDLDNLLAQIGDQYADL

FLAAKNLSDAILLSDILRVNTEITKAPLSASMIKRYDEHHQDLTLLKALVRQQLPEKY

KEIFFDQSKNGYAGYIDGGASQEEFYKFIKPILEKMDGTEELLVKLNREDLLRKQRTF

DNGSIPHQIHLGELHAILRRQEDFYPFLKDNREKIEKILTFRIPYYVGPLARGNSRFAW

MTRKSEETITPWNFEEVVDKGASAQSFIERMTNFDKNLPNEKVLPKHSLLYEYFTVY

NELTKVKYVTEGMRKPAFLSGEQKKAIVDLLFKTNRKVTVKQLKEDYFKKIECFDS

VEISGVEDRFNASLGTYHDLLKIIKDKDFLDNEENEDILEDIVLTLTLFEDREMIEERL

KTYAHLFDDKVMKQLKRRRYTGWGRLSRKLINGIRDKQSGKTILDFLKSDGFANRN

FMQLIHDDSLTFKEDIQKAQVSGQGDSLHEHIANLAGSPAIKKGILQTVKVVDELVK

VMGRHKPENIVIEMARENQTTQKGQKNSRERMKRIEEGIKELGSQILKEHPVENTQL

QNEKLYLYYLQNGRDMYVDQELDINRLSDYDVDHIVPQSFLKDDSIDNKVLTRSDK

NRGKSDNVPSEEVVKKMKNYWRQLLNAKLITQRKFDNLTKAERGGLSELDKAGFIK

RQLVETRQITKHVAQILDSRMNTKYDENDKLIREVKVITLKSKLVSDFRKDFQFYKV

REINNYHHAHDAYLNAVVGTALIKKYPKLESEFVYGDYKVYDVRKMIAKSEQEIGK

ATAKYFFYSNIMNFFKTEITLANGEIRKRPLIETNGETGEIVWDKGRDFATVRKVLSM

PQVNIVKKTEVQTGGFSKESILPKRNSDKLIARKKDWDPKKYGGFDSPTVAYSVLVV

AKVEKGKSKKLKSVKELLGITIMERSSFEKNPIDFLEAKGYKEVKKDLIIKLPKYSLFE

LENGRKRMLASAGELQKGNELALPSKYVNFLYLASHYEKLKGSPEDNEQKQLFVEQ

HKHYLDEIIEQISEFSKRVILADANLDKVLSAYNKHRDKPIREQAENIIHLFTLTNLGA

PAAFKYFDTTIDRKRYTSTKEVLDATLIHQSITGLYETRIDLSQLGGDSGGSGGSGGST

NLSDIIEKETGKQLVIQESILMLPEEVEEVIGNKPESDILVHTAYDESTDENVMLLTSD

APEYKPWALVIQDSNGENKIKMLSGGSGGSGGSTNLSDIIEKETGKQLVIQESILMLPE

EVEEVIGNKPESDILVHTAYDESTDENVMLLTSDAPEYKPWALVIQDSNGENKIKML

SGGSKRTADGSEFEPKKKRKV

AncBE4max687: (SEQ ID NO: 14)
MKRTADGSEFESPKKKRKVSSETGPVAVDPTLRRRIEPHEFEVFFDPRE

LRKEACLLYEIKWGTSHKIWRNSGKNTTKHVEVNFIEKFTSERHFCPSISCSITWFLS

WSPCWECSKAIREFLSQHPNVTLVIYVARLFQHMDQQNRQGLRDLVNSGVTIQIMTA

SEYDHCWRNFVNYPPGKEAHWPRYPPLWMKLYALELHAGILGLPPCLNILRRKQPQ

-continued

LTFFTIALQSCHYQRLPPHILWATGLKSGGSSGGSSGSETPGTSESATPESSGGSSGGS

DKKYSIGLAIGTNSVGWAVITDEYKVPSKKFKVLGNTDRHSIKKNLIGALLFDSGETA

EATRLKRTARRRYTRRKNRICYLQEIFSNEMAKVDDSFFHRLEESFLVEEDKKHERH

PIFGNIVDEVAYHEKYPTIYHLRKKLVDSTDKADLRLIYLALAHMIKFRGHFLIEGDL

NPDNSDVDKLFIQLVQTYNQLFEENPINASGVDAKAILSARLSKSRRLENLIAQLPGE

KKNGLFGNLIALSLGLTPNFKSNFDLAEDAKLQLSKDTYDDDLDNLLAQIGDQYADL

FLAAKNLSDAILLSDILRVNTEITKAPLSASMIKRYDEHHQDLTLLKALVRQQLPEKY

KEIFFDQSKNGYAGYIDGGASQEEFYKFIKPILEKMDGTEELLVKLNREDLLRKQRTF

DNGSIPHQIHLGELHAILRRQEDFYPFLKDNREKIEKILTFRIPYYVGPLARGNSRFAW

MTRKSEETITPWNFEEVVDKGASAQSFIERMTNFDKNLPNEKVLPKHSLLYEYFTVY

NELTKVKYVTEGMRKPAFLSGEQKKAIVDLLFKTNRKVTVKQLKEDYFKKIECFDS

VEISGVEDRFNASLGTYHDLLKIIKDKDFLDNEENEDILEDIVLTLTLFEDREMIEERL

KTYAHLFDDKVMKQLKRRRYTGWGRLSRKLINGIRDKQSGKTILDFLKSDGFANRN

FMQLIHDDSLTFKEDIQKAQVSGQGDSLHEHIANLAGSPAIKKGILQTVKVVDELVK

VMGRHKPENIVIEMARENQTTQKGQKNSRERMKRIEEGIKELGSQILKEHPVENTQL

QNEKLYLYYLQNGRDMYVDQELDINRLSDYDVDHIVPQSFLKDDSIDNKVLTRSDK

NRGKSDNVPSEEVVKKMKNYWRQLLNAKLITQRKFDNLTKAERGGLSELDKAGFIK

RQLVETRQITKHVAQILDSRMNTKYDENDKLIREVKVITLKSKLVSDFRKDFQFYKV

REINNYHHAHDAYLNAVVGTALIKKYPKLESEFVYGDYKVYDVRKMIAKSEQEIGK

ATAKYFFYSNIMNFFKTEITLANGEIRKRPLIETNGETGEIVWDKGRDFATVRKVLSM

PQVNIVKKTEVQTGGFSKESILPKRNSDKLIARKKDWDPKKYGGFDSPTVAYSVLVV

AKVEKGKSKKLKSVKELLGITIMERSSFEKNPIDFLEAKGYKEVKKDLIIKLPKYSLFE

LENGRKRMLASAGELQKGNELALPSKYVNFLYLASHYEKLKGSPEDNEQKQLFVEQ

HKHYLDEIIEQISEFSKRVILADANLDKVLSAYNKHRDKPIREQAENIIHLFTLTNLGA

PAAFKYFDTTIDRKRYTSTKEVLDATLIHQSITGLYETRIDLSQLGGDSGGSGGSGGST

NLSDIIEKETGKQLVIQESILMLPEEVEEVIGNKPESDILVHTAYDESTDENVMLLTSD

APEYKPWALVIQDSNGENKIKMLSGGSGGSGGSTNLSDIIEKETGKQLVIQESILMLPE

EVEEVIGNKPESDILVHTAYDESTDENVMLLTSDAPEYKPWALVIQDSNGENKIKML

SGGSKRTADGSEFEPKKKRKV

TadA WT:
(SEQ ID NO: 15)
MSEVEFSHEYWMRHALTLAKRAWDEREVPVGAVLVHNNRVIGEGW

NRPIGRHDPTAHAEIMALRQGGLVMQNYRLIDATLYVTLEPCVMCAGAMIHSRIGR

VVFGARDAKTGAAGSLMDVLHHPGMNHRVEITEGILADECAALLSDFFRMRRQEIK

AQKKAQSSTD

*Staphylococcus aureus* TadA:
(SEQ ID NO: 16)
MGSHMTNDIYFMTLAIEEAKKAAQLGEVPIGAIITKDDEVIARAHNLR

ETLQQPTAHAEHIAIERAAKVLGSWRLEGCTLYVTLEPCVMCAGTIVMSRIPRVVYG

ADDPKGGCSGSLMNLLQQSNFNHRAIVDKGVLKEACSTLLTTFFKNLRANKKSTN

-continued

*Bacillus subtilis* TadA:
(SEQ ID NO: 17)
MTQDELYMKEAIKEAKKAEEKGEVPIGAVLVINGEIIARAHNLRETEQ

RSIAHAEMLVID

EACKALGTWRLEGATLYVTLEPCPMCAGAVVLSRVEKVVFGAFDPK

GGCSGTLMNLLQEERFNHQAEVVSGVLEEECGGMLSAFFRELRKKKAARKNLSE

*Salmonella typhimurium* (*S. typhimurium*) TadA:
(SEQ ID NO: 18)
MPPAFITGVTSLSDVELDHEYWMRHALTLAKRAWDEREVPVGAVLV

HNHRVIGEGWNRPIGRHDPTAHAEIMALRQGGLVLQNYRLLDTTLYVTLEPCVMCA

GAMVHSRIGRVVFGARDAKTGAAGSLIDVLHHPGMNHRVEIIEGVLRDECATLLSDF

FRMRRQEIKALKKADRAEGAGPAV

*Shewanella putrefaciens* (*S. putrefaciens*) TadA:
(SEQ ID NO: 19)
MDEYWMQVAMQMAEKAEAAGEVPVGAVLVKDGQQIATGYNLSISQ

HDPTAHAEILCLRSAGKKLENYRLLDATLYITLEPCAMCAGAMVHSRIARVVYGAR

DEKTGAAGTVVNLLQHPAFNHQVEVTSGVLAEACSAQLSRFFKRRRDEKKALKLAQ

RAQQGIE

*Haemophilus influenzae* F3031 (*H. influenzae*) TadA:
(SEQ ID NO: 20)
MDAAKVRSEFDEKMMRYALELADKAEALGEIPVGAVLVDDARNIIGE

GWNLSIVQSDPTAHAEIIALRNGAKNIQNYRLLNSTLYVTLEPCTMCAGAILHSRIKR

LVFGASDYKTGAIGSRFHFFDDYKMNHTLEITSGVLAEECSQKLSTFFQKRREEKKIE

KALLKSLSDK

*Caulobacter crescentus* (*C. crescentus*) TadA:
(SEQ ID NO: 21)
MRTDESEDQDHRMMRLALDAARAAAEAGETPVGAVILDPSTGEVIAT

AGNGPIAAHDPTAHAEIAAMRAAAAKLGNYRLTDLTLVVTLEPCAMCAGAISHARI

GRVVFGADDPKGGAVVHGPKFFAQPTCHWRPEVTGGVLADESADLLRGFFRARRK

AKI

*Geobacter sulfurreducens* (*G. sulfurreducens*) TadA:
(SEQ ID NO: 22)
MSSLKKTPIRDDAYWMGKAIREAAKAAARDEVPIGAVIVRDGAVIGR

GHNLREGSNDPSAHAEMIAIRQAARRSANWRLTGATLYVTLEPCLMCMGAIILARLE

RVVFGCYDPKGGAAGSLYDLSADPRLNHQVRLSPGVCQEECGTMLSDFFRDLRRRK

KAKATPALFIDERKVPPEP

TadA 7.10:
(SEQ ID NO: 23)
SEVEFSHEYWMRHALTLAKRARDEREVPVGAVLVLNNRVIGEGWNR

AIGLHDPTAHAEIMALRQGGLVMQNYRLIDATLYVTFEPCVMCAGAMIHSRIGRVVF

GVRNAKTGAAGSLMDVLHYPGMNHR VEITEGILADECAALLCYFFRMPRQVFNAQ

KKAQSSTD

ABEmax:
(SEQ ID NO: 24)
MKRTADGSEFESPKKKRKVMSEVEFSHEYWMRHALTLAKRAWDERE

VPVGAVLVHNNRVIGEGWNRPIGRHDPTAHAEIMALRQGGLVMQNYRLIDATLYVT

LEPCVMCAGAMIHSRIGRVVFGARDAKTGAAGSLMDVLHHPGMNHRVEITEGILAD

ECAALLSDFFRMRRQEIKAQKKAQSSTDSGGSSGGSSGSETPGTSESATPESSGGSSG

-continued

GSSEVEFSHEYWMRHALTLAKRARDEREVPVGAVLVLNNRVIGEGWNRAIGLHDPT

AHAEIMALRQGGLVMQNYRLIDATLYVTFEPCVMCAGAMIHSRIGRVVFGVRNAKT

GAAGSLMDVLHYPGMNHRVEITEGILADECAALLCYFFRMPRQVFNAQKKAQSSTD

SGGSSGGSSGSETPGTSESATPESSGGSSGGSDKKYSIGLAIGTNSVGWAVITDEYKVP

SKKFKVLGNTDRHSIKKNLIGALLFDSGETAEATRLKRTARRRYTRRKNRICYLQEIF

SNEMAKVDDSFFHRLEESFLVEEDKKHERHPIFGNIVDEVAYHEKYPTIYHLRKKLV

DSTDKADLRLIYLALAHMIKFRGHFLIEGDLNPDNSDVDKLFIQLVQTYNQLFEENPI

NASGVDAKAILSARLSKSRRLENLIAQLPGEKKNGLFGNLIALSLGLTPNFKSNFDLA

EDAKLQLSKDTYDDDLDNLLAQIGDQYADLFLAAKNLSDAILLSDILRVNTEITKAPL

SASMIKRYDEHHQDLTLLKALVRQQLPEKYKEIFFDQSKNGYAGYIDGGASQEEFYK

FIKPILEKMDGTEELLVKLNREDLLRKQRTFDNGSIPHQIHLGELHAILRRQEDFYPFL

KDNREKIEKILTFRIPYYVGPLARGNSRFAWMTRKSEETITPWNFEEVVDKGASAQSF

IERMTNFDKNLPNEKVLPKHSLLYEYFTVYNELTKVKYVTEGMRKPAFLSGEQKKAI

VDLLFKTNRKVTVKQLKEDYFKKIECFDSVEISGVEDRFNASLGTYHDLLKIIKDKDF

LDNEENEDILEDIVLTLTLFEDREMIEERLKTYAHLFDDKVMKQLKRRRYTGWGRLS

RKLINGIRDKQSGKTILDFLKSDGFANRNFMQLIHDDSLTFKEDIQKAQVSGQGDSLH

EHIANLAGSPAIKKGILQTVKVVDELVKVMGRHKPENIVIEMARENQTTQKGQKNSR

ERMKRIEEGIKELGSQILKEHPVENTQLQNEKLYLYYLQNGRDMYVDQELDINRLSD

YDVDHIVPQSFLKDDSIDNKVLTRSDKNRGKSDNVPSEEVVKKMKNYWRQLLNAK

LITQRKFDNLTKAERGGLSELDKAGFIKRQLVETRQITKHVAQILDSRMNTKYDEND

KLIREVKVITLKSKLVSDFRKDFQFYKVREINNYHHAHDAYLNAVVGTALIKKYPKL

ESEFVYGDYKVYDVRKMIAKSEQEIGKATAKYFFYSNIMNFFKTEITLANGEIRKRPL

IETNGETGEIVWDKGRDFATVRKVLSMPQVNIVKKTEVQTGGFSKESILPKRNSDKLI

ARKKDWDPKKYGGFDSPTVAYSVLVVAKVEKGKSKKLKSVKELLGITIMERSSFEK

NPIDFLEAKGYKEVKKDLIIKLPKYSLFELENGRKRMLASAGELQKGNELALPSKYV

NFLYLASHYEKLKGSPEDNEQKQLFVEQHKHYLDEIIEQISEFSKRVILADANLDKVL

SAYNKHRDKPIREQAENIIHLFTLTNLGAPAAFKYFDTTIDRKRYTSTKEVLDATLIHQ

SITGLYETRIDLSQLGGDKRTADGSEFEPKKKRKV 10 a.a. linker:
(SEQ ID NO: 25)
SGGSGGSGGS 4 a.a. linker:
(SEQ ID NO: 26)
SGGS N-term NLS:
(SEQ ID NO: 27)
AAACGGACAGCCGACGGAAGCGAGTTCGAGTCACCAAAGAAGAAG
CGGAAAGTC C-term NLS:
(SEQ ID NO: 28)
AAAAGAACCGCCGACGGCAGCGAATTCGAGCCCAAGAAGAAGAG
GAAAGTC Cas9 BE4max:
(SEQ ID NO: 29)
GACAAGAAGTACAGCATCGGCCTGGACATCGGCACCAACTCTGTG

GGCTGGGCCGTGATCACCGACGAGTACAAGGTGCCCAGCAAGAAATTCAAGGTG

-continued

```
CTGGGCAACACCGACCGGCACAGCATCAAGAAGAACCTGATCGGAGCCCTGCTG

TTCGACAGCGGCGAAACAGCCGAGGCCACCCGGCTGAAGAGAACCGCCAGAAG

AAGATACACCAGACGGAAGAACCGGATCTGCTATCTGCAAGAGATCTTCAGCAA

CGAGATGGCCAAGGTGGACGACAGCTTCTTCCACAGACTGGAAGAGTCCTTCCT

GGTGGAAGAGGATAAGAAGCACGAGCGGCACCCCATCTTCGGCAACATCGTGGA

CGAGGTGGCCTACCACGAGAAGTACCCCACCATCTACCACCTGAGAAAGAAACT

GGTGGACAGCACCGACAAGGCCGACCTGCGGCTGATCTATCTGGCCCTGGCCCA

CATGATCAAGTTCCGGGGCCACTTCCTGATCGAGGGCGACCTGAACCCCGACAA

CAGCGACGTGGACAAGCTGTTCATCCAGCTGGTGCAGACCTACAACCAGCTGTTC

GAGGAAAACCCCATCAACGCCAGCGGCGTGGACGCCAAGGCCATCCTGTCTGCC

AGACTGAGCAAGAGCAGACGGCTGGAAAATCTGATCGCCCAGCTGCCCGGCGAG

AAGAAGAATGGCCTGTTCGGAAACCTGATTGCCCTGAGCCTGGGCCTGACCCCC

AACTTCAAGAGCAACTTCGACCTGGCCGAGGATGCCAAACTGCAGCTGAGCAAG

GACACCTACGACGACGACCTGGACAACCTGCTGGCCCAGATCGGCGACCAGTAC

GCCGACCTGTTTCTGGCCGCCAAGAACCTGTCCGACGCCATCCTGCTGAGCGACA

TCCTGAGAGTGAACACCGAGATCACCAAGGCCCCCCTGAGCGCCTCTATGATCA

AGAGATACGACGAGCACCACCAGGACCTGACCCTGCTGAAAGCTCTCGTGCGGC

AGCAGCTGCCTGAGAAGTACAAAGAGATTTTCTTCGACCAGAGCAAGAACGGCT

ACGCCGGCTACATTGACGGCGGAGCCAGCCAGGAAGAGTTCTACAAGTTCATCA

AGCCCATCCTGGAAAAGATGGACGGCACCGAGGAACTGCTCGTGAAGCTGAACA

GAGAGGACCTGCTGCGGAAGCAGCGGACCTTCGACAACGGCAGCATCCCCCACC

AGATCCACCTGGGAGAGCTGCACGCCATTCTGCGGCGGCAGGAAGATTTTTACCC

ATTCCTGAAGGACAACCGGGAAAAGATCGAGAAGATCCTGACCTTCCGCATCCC

CTACTACGTGGGCCCTCTGGCCAGGGGAAACAGCAGATTCGCCTGGATGACCAG

AAAGAGCGAGGAAACCATCACCCCCTGGAACTTCGAGGAAGTGGTGGACAAGG

GCGCTTCCGCCCAGAGCTTCATCGAGCGGATGACCAACTTCGATAAGAACCTGCC

CAACGAGAAGGTGCTGCCCAAGCACAGCCTGCTGTACGAGTACTTCACCGTGTAT

AACGAGCTGACCAAAGTGAAATACGTGACCGAGGGAATGAGAAAGCCCGCCTTC

CTGAGCGGCGAGCAGAAAAAGGCCATCGTGGACCTGCTGTTCAAGACCAACCGG

AAAGTGACCGTGAAGCAGCTGAAAGAGGACTACTTCAAGAAAATCGAGTGCTTC

GACTCCGTGGAAATCTCCGGCGTGGAAGATCGGTTCAACGCCTCCCTGGGCACAT

ACCACGATCTGCTGAAAATTATCAAGGACAAGGACTTCCTGGACAATGAGGAAA

ACGAGGACATTCTGGAAGATATCGTGCTGACCCTGACACTGTTTGAGGACAGAG

AGATGATCGAGGAACGGCTGAAAACCTATGCCCACCTGTTCGACGACAAAGTGA

TGAAGCAGCTGAAGCGGCGGAGATACACCGGCTGGGGCAGGCTGAGCCGGAAG

CTGATCAACGGCATCCGGGACAAGCAGTCCGGCAAGACAATCCTGGATTTCCTG

AAGTCCGACGGCTTCGCCAACAGAAACTTCATGCAGCTGATCCACGACGACAGC

CTGACCTTTAAAGAGGACATCCAGAAAGCCCAGGTGTCCGGCCAGGGCGATAGC

CTGCACGAGCACATTGCCAATCTGGCCGGCAGCCCCGCCATTAAGAAGGGCATC

CTGCAGACAGTGAAGGTGGTGGACGAGCTCGTGAAAGTGATGGGCCGGCACAAG
```

-continued

CCCGAGAACATCGTGATCGAAATGGCCAGAGAGAACCAGACCACCCAGAAGGG

ACAGAAGAACAGCCGCGAGAGAATGAAGCGGATCGAAGAGGGCATCAAAGAGC

TGGGCAGCCAGATCCTGAAAGAACACCCCGTGGAAAACACCCAGCTGCAGAACG

AGAAGCTGTACCTGTACTACCTGCAGAATGGGCGGGATATGTACGTGGACCAGG

AACTGGACATCAACCGGCTGTCCGACTACGATGTGGACCATATCGTGCCTCAGAG

CTTTCTGAAGGACGACTCCATCGACAACAAGGTGCTGACCAGAAGCGACAAGAA

CCGGGGCAAGAGCGACAACGTGCCCTCCGAAGAGGTCGTGAAGAAGATGAAGA

ACTACTGGCGGCAGCTGCTGAACGCCAAGCTGATTACCCAGAGAAAGTTCGACA

ATCTGACCAAGGCCGAGAGAGGCGGCCTGAGCGAACTGGATAAGGCCGGCTTCA

TCAAGAGACAGCTGGTGGAAACCCGGCAGATCACAAAGCACGTGGCACAGATCC

TGGACTCCCGGATGAACACTAAGTACGACGAGAATGACAAGCTGATCCGGGAAG

TGAAAGTGATCACCCTGAAGTCCAAGCTGGTGTCCGATTTCCGGAAGGATTTCCA

GTTTTACAAAGTGCGCGAGATCAACAACTACCACCACGCCCACGACGCCTACCT

GAACGCCGTCGTGGGAACCGCCCTGATCAAAAAGTACCCTAAGCTGGAAAGCGA

GTTCGTGTACGGCGACTACAAGGTGTACGACGTGCGGAAGATGATCGCCAAGAG

CGAGCAGGAAATCGGCAAGGCTACCGCCAAGTACTTCTTCTACAGCAACATCAT

GAACTTTTTCAAGACCGAGATTACCCTGGCCAACGGCGAGATCCGGAAGCGGCC

TCTGATCGAGACAAACGGCGAAACCGGGGAGATCGTGTGGGATAAGGGCCGGG

ATTTTGCCACCGTGCGGAAAGTGCTGAGCATGCCCCAAGTGAATATCGTGAAAA

AGACCGAGGTGCAGACAGGCGGCTTCAGCAAAGAGTCTATCCTGCCCAAGAGGA

ACAGCGATAAGCTGATCGCCAGAAAGAAGGACTGGGACCCTAAGAAGTACGGC

GGCTTCGACAGCCCCACCGTGGCCTATTCTGTGCTGGTGGTGGCCAAAGTGGAAA

AGGGCAAGTCCAAGAAACTGAAGAGTGTGAAAGAGCTGCTGGGGATCACCATCA

TGGAAAGAAGCAGCTTCGAGAAGAATCCCATCGACTTTCTGGAAGCCAAGGGCT

ACAAAGAAGTGAAAAAGGACCTGATCATCAAGCTGCCTAAGTACTCCCTGTTCG

AGCTGGAAAACGGCCGGAAGAGAATGCTGGCCTCTGCCGGCGAACTGCAGAAGG

GAAACGAACTGGCCCTGCCCTCCAAATATGTGAACTTCCTGTACCTGGCCAGCCA

CTATGAGAAGCTGAAGGGCTCCCCCGAGGATAATGAGCAGAAACAGCTGTTTGT

GGAACAGCACAAGCACTACCTGGACGAGATCATCGAGCAGATCAGCGAGTTCTC

CAAGAGAGTGATCCTGGCCGACGCTAATCTGGACAAAGTGCTGTCCGCCTACAA

CAAGCACCGGGATAAGCCCATCAGAGAGCAGGCCGAGAATATCATCCACCTGTT

TACCCTGACCAATCTGGGAGCCCCTGCCGCCTTCAAGTACTTTGACACCACCATC

GACCGGAAGAGGTACACCAGCACCAAAGAGGTGCTGGACGCCACCCTGATCCAC

CAGAGCATCACCGGCCTGTACGAGACACGGATCGACCTGTCTCAGCTGGGAGGT

GAC

Cas9 ABEmax:

(SEQ ID NO: 30)
GACAAGAAGTACAGCATCGGCCTGGCCATCGGCACCAACTCTGTG

GGCTGGGCCGTGATCACCGACGAGTACAAGGTGCCCAGCAAGAAATTCAAGGTG

CTGGGCAACACCGACCGGCACAGCATCAAGAAGAACCTGATCGGAGCCCTGCTG

TTCGACAGCGGCGAAACAGCCGAGGCCACCCGGCTGAAGAGAACCGCCAGAAG

AAGATACACCAGACGGAAGAACCGGATCTGCTATCTGCAAGAGATCTTCAGCAA

-continued

```
CGAGATGGCCAAGGTGGACGACAGCTTCTTCCACAGACTGGAAGAGTCCTTCCT

GGTGGAAGAGGATAAGAAGCACGAGCGGCACCCCATCTTCGGCAACATCGTGGA

CGAGGTGGCCTACCACGAGAAGTACCCCACCATCTACCACCTGAGAAAGAAACT

GGTGGACAGCACCGACAAGGCCGACCTGCGGCTGATCTATCTGGCCCTGGCCCA

CATGATCAAGTTCCGGGGCCACTTCCTGATCGAGGGCGACCTGAACCCCGACAA

CAGCGACGTGGACAAGCTGTTCATCCAGCTGGTGCAGACCTACAACCAGCTGTTC

GAGGAAAACCCCATCAACGCCAGCGGCGTGGACGCCAAGGCCATCCTGTCTGCC

AGACTGAGCAAGAGCAGACGGCTGGAAAATCTGATCGCCCAGCTGCCCGGCGAG

AAGAAGAATGGCCTGTTCGGAAACCTGATTGCCCTGAGCCTGGGCCTGACCCCC

AACTTCAAGAGCAACTTCGACCTGGCCGAGGATGCCAAACTGCAGCTGAGCAAG

GACACCTACGACGACGACCTGGACAACCTGCTGGCCCAGATCGGCGACCAGTAC

GCCGACCTGTTTCTGGCCGCCAAGAACCTGTCCGACGCCATCCTGCTGAGCGACA

TCCTGAGAGTGAACACCGAGATCACCAAGGCCCCCCTGAGCGCCTCTATGATCA

AGAGATACGACGAGCACCACCAGGACCTGACCCTGCTGAAAGCTCTCGTGCGGC

AGCAGCTGCCTGAGAAGTACAAAGAGATTTTCTTCGACCAGAGCAAGAACGGCT

ACGCCGGCTACATTGACGGCGGAGCCAGCCAGGAAGAGTTCTACAAGTTCATCA

AGCCCATCCTGGAAAAGATGGACGGCACCGAGGAACTGCTCGTGAAGCTGAACA

GAGAGGACCTGCTGCGGAAGCAGCGGACCTTCGACAACGGCAGCATCCCCCACC

AGATCCACCTGGGAGAGCTGCACGCCATTCTGCGGCGGCAGGAAGATTTTTACCC

ATTCCTGAAGGACAACCGGGAAAAGATCGAGAAGATCCTGACCTTCCGCATCCC

CTACTACGTGGGCCCTCTGGCCAGGGGAAACAGCAGATTCGCCTGGATGACCAG

AAAGAGCGAGGAAACCATCACCCCCTGGAACTTCGAGGAAGTGGTGGACAAGG

GCGCTTCCGCCCAGAGCTTCATCGAGCGGATGACCAACTTCGATAAGAACCTGCC

CAACGAGAAGGTGCTGCCCAAGCACAGCCTGCTGTACGAGTACTTCACCGTGTAT

AACGAGCTGACCAAAGTGAAATACGTGACCGAGGGAATGAGAAAGCCCGCCTTC

CTGAGCGGCGAGCAGAAAAAGGCCATCGTGGACCTGCTGTTCAAGACCAACCGG

AAAGTGACCGTGAAGCAGCTGAAAGAGGACTACTTCAAGAAAATCGAGTGCTTC

GACTCCGTGGAAATCTCCGGCGTGGAAGATCGGTTCAACGCCTCCCTGGGCACAT

ACCACGATCTGCTGAAAATTATCAAGGACAAGGACTTCCTGGACAATGAGGAAA

ACGAGGACATTCTGGAAGATATCGTGCTGACCCTGACACTGTTTGAGGACAGAG

AGATGATCGAGGAACGGCTGAAAACCTATGCCCACCTGTTCGACGACAAAGTGA

TGAAGCAGCTGAAGCGGCGGAGATACACCGGCTGGGGCAGGCTGAGCCGGAAG

CTGATCAACGGCATCCGGGACAAGCAGTCCGGCAAGACAATCCTGGATTTCCTG

AAGTCCGACGGCTTCGCCAACAGAAACTTCATGCAGCTGATCCACGACGACAGC

CTGACCTTTAAAGAGGACATCCAGAAAGCCCAGGTGTCCGGCCAGGGCGATAGC

CTGCACGAGCACATTGCCAATCTGGCCGGCAGCCCCGCCATTAAGAAGGGCATC

CTGCAGACAGTGAAGGTGGTGGACGAGCTCGTGAAAGTGATGGGCCGGCACAAG

CCCGAGAACATCGTGATCGAAATGGCCAGAGAGAACCAGACCACCCAGAAGGG

ACAGAAGAACAGCCGCGAGAGAATGAAGCGGATCGAAGAGGGCATCAAAGAGC

TGGGCAGCCAGATCCTGAAAGAACACCCCGTGGAAAACACCCAGCTGCAGAACG
```

-continued

```
AGAAGCTGTACCTGTACTACCTGCAGAATGGGCGGGATATGTACGTGGACCAGG

AACTGGACATCAACCGGCTGTCCGACTACGATGTGGACCATATCGTGCCTCAGAG

CTTTCTGAAGGACGACTCCATCGACAACAAGGTGCTGACCAGAAGCGACAAGAA

CCGGGGCAAGAGCGACAACGTGCCCTCCGAAGAGGTCGTGAAGAAGATGAAGA

ACTACTGGCGGCAGCTGCTGAACGCCAAGCTGATTACCCAGAGAAAGTTCGACA

ATCTGACCAAGGCCGAGAGAGGCGGCCTGAGCGAACTGGATAAGGCCGGCTTCA

TCAAGAGACAGCTGGTGGAAACCCGGCAGATCACAAAGCACGTGGCACAGATCC

TGGACTCCGGATGAACACTAAGTACGACGAGAATGACAAGCTGATCCGGGAAG

TGAAAGTGATCACCCTGAAGTCCAAGCTGGTGTCCGATTTCCGGAAGGATTTCCA

GTTTTACAAAGTGCGCGAGATCAACAACTACCACCACGCCCACGACGCCTACCT

GAACGCCGTCGTGGGAACCGCCCTGATCAAAAAGTACCCTAAGCTGGAAAGCGA

GTTCGTGTACGGCGACTACAAGGTGTACGACGTGCGGAAGATGATCGCCAAGAG

CGAGCAGGAAATCGGCAAGGCTACCGCCAAGTACTTCTTCTACAGCAACATCAT

GAACTTTTTCAAGACCGAGATTACCCTGGCCAACGGCGAGATCCGGAAGCGGCC

TCTGATCGAGACAAACGGCGAAACCGGGGAGATCGTGTGGGATAAGGGCCGGG

ATTTTGCCACCGTGCGGAAAGTGCTGAGCATGCCCCAAGTGAATATCGTGAAAA

AGACCGAGGTGCAGACAGGCGGCTTCAGCAAAGAGTCTATCCTGCCCAAGAGGA

ACAGCGATAAGCTGATCGCCAGAAAGAAGGACTGGGACCCTAAGAAGTACGGC

GGCTTCGACAGCCCCACCGTGGCCTATTCTGTGCTGGTGGTGGCCAAAGTGGAAA

AGGGCAAGTCCAAGAAACTGAAGAGTGTGAAAGAGCTGCTGGGGATCACCATCA

TGGAAAGAAGCAGCTTCGAGAAGAATCCCATCGACTTTCTGGAAGCCAAGGGCT

ACAAAGAAGTGAAAAAGGACCTGATCATCAAGCTGCCTAAGTACTCCCTGTTCG

AGCTGGAAAACGGCCGGAAGAGAATGCTGGCCTCTGCCGGCGAACTGCAGAAGG

GAAACGAACTGGCCCTGCCCTCCAAATATGTGAACTTCCTGTACCTGGCCAGCCA

CTATGAGAAGCTGAAGGGCTCCCCCGAGGATAATGAGCAGAAACAGCTGTTTGT

GGAACAGCACAAGCACTACCTGGACGAGATCATCGAGCAGATCAGCGAGTTCTC

CAAGAGAGTGATCCTGGCCGACGCTAATCTGGACAAAGTGCTGTCCGCCTACAA

CAAGCACCGGGATAAGCCCATCAGAGAGCAGGCCGAGAATATCATCCACCTGTT

TACCCTGACCAATCTGGGAGCCCCTGCCGCCTTCAAGTACTTTGACACCACCATC

GACCGGAAGAGGTACACCAGCACCAAAGAGGTGCTGGACGCCACCCTGATCCAC

CAGAGCATCACCGGCCTGTACGAGACACGGATCGACCTGTCTCAGCTGGGAGGT

GAC
```

BE4max XTEN linker:
(SEQ ID NO: 31)
```
TCTGGAGGATCTAGCGGAGGATCCTCTGGCAGCGAGACACCAGGA

ACAAGCGAGTCAGCAACACCAGAGAGCAGTGGCGGCAGCAGCGGCGGCAGC
```

ABEmax XTEN linker first:
(SEQ ID NO: 32)
```
TCTGGAGGATCTAGCGGAGGATCCTCTGGAAGCGAGACACCAGGC

ACAAGCGAGTCCGCCACACCAGAGAGCTCCGGCGGCTCCTCCGGAGGATCC
```

ABEmax XTEN linker second:
(SEQ ID NO: 33)
```
TCCGGAGGATCTAGCGGAGGCTCCTCTGGCTCTGAGACACCTGGCA

CAAGCGAGAGCGCAACACCTGAAAGCAGCGGGGGCAGCAGCGGGGGGTCA
```

-continued

BE4max 10 a.a. linker 1:
(SEQ ID NO: 34)
AGCGGCGGGAGCGGCGGGAGCGGGGGAGC

BE4max 10 a.a. linker 2:
(SEQ ID NO: 35)
AGCGGAGGATCCGGAGGATCTGGAGGCAGC

BE4max 4 a.a. linker:
(SEQ ID NO: 36)
TCTGGCGGCTCA

Rat APOBEC1:
(SEQ ID NO: 37)
TCCTCAGAGACTGGGCCTGTCGCCGTCGATCCAACCCTGCGCCGCC

GGATTGAACCTCACGAGTTTGAAGTGTTCTTTGACCCCCGGGAGCTGAGAAAGG

AGACATGCCTGCTGTACGAGATCAACTGGGGAGGCAGGCACTCCATCTGGAGGC

ACACCTCTCAGAACACAAATAAGCACGTGGAGGTGAACTTCATCGAGAAGTTTA

CCACAGAGCGGTACTTCTGCCCCAATACCAGATGTAGCATCACATGGTTTCTGAG

CTGGTCCCCTTGCGGAGAGTGTAGCAGGGCCATCACCGAGTTCCTGTCCAGATAT

CCACACGTGACACTGTTTATCTACATCGCCAGGCTGTATCACCACGCAGACCCAA

GGAATAGGCAGGGCCTGCGCGATCTGATCAGCTCCGGCGTGACCATCCAGATCA

TGACAGAGCAGGAGTCCGGCTACTGCTGGCGGAACTTCGTGAATTATTCTCCTAG

CAACGAGGCCCACTGGCCTAGGTACCCACACCTGTGGGTGCGCCTGTACGTGCTG

GAGCTGTATTGCATCATCCTGGGCCTGCCCCCTTGTCTGAATATCCTGCGGAGAA

AGCAGCCCCAGCTGACCTTCTTTACAATCGCCCTGCAGTCTTGTCACTATCAGAG

GCTGCCACCCCACATCCTGTGGGCCACAGGCCTGAAG

Anc689 APOBEC:
(SEQ ID NO: 38)
AGCAGTGAAACCGGACCAGTGGCAGTGGACCCAACCCTGAGGAGA

CGGATTGAGCCCCATGAATTTGAAGTGTTCTTTGACCCAAGGGAGCTGAGGAAG

GAGACATGCCTGCTGTACGAGATCAAGTGGGGCACAAGCCACAAGATCTGGCGC

CACAGCTCCAAGAACACCACAAAGCACGTGGAAGTGAATTTCATCGAGAAGTTT

ACCTCCGAGCGGCACTTCTGCCCCTCTACCAGCTGTTCCATCACATGGTTTCTGTC

TTGGAGCCCTTGCGGCGAGTGTTCCAAGGCCATCACCGAGTTCCTGTCTCAGCAC

CCTAACGTGACCCTGGTCATCTACGTGGCCCGGCTGTATCACCACATGGACCAGC

AGAACAGGCAGGGCCTGCGCGATCTGGTGAATTCTGGCGTGACCATCCAGATCA

TGACAGCCCCAGAGTACGACTATTGCTGGCGGAACTTCGTGAATTATCCACCTGG

CAAGGAGGCACACTGGCCAAGATACCCACCCCTGTGGATGAAGCTGTATGCACT

GGAGCTGCACGCAGGAATCCTGGGCCTGCCTCCATGTCTGAATATCCTGCGGAGA

AAGCAGCCCCAGCTGACATTTTTCACCATTGCTCTGCAGTCTTGTCACTATCAGC

GGCTGCCTCCTCATATTCTGTGGGCTACAGGCCTTAAA

Anc687 APOBEC:
(SEQ ID NO: 39)
TCATCAGAAACAGGACCAGTCGCCGTGGACCCAACACTGAGGAGA

AGGATTGAGCCCCATGAATTTGAAGTCTTTTTCGACCCCAGGGAGCTGAGGAAG

GAGGCATGCCTGCTGTACGAGATCAAGTGGGGCACAAGCCACAAGATCTGGCGC

AACAGCGGCAAGAACACCACAAAGCACGTGGAAGTGAATTTCATCGAGAAGTTT

ACCTCCGAGCGGCACTTCTGCCCCTCTATCAGCTGTTCCATCACATGGTTTCTGTC

-continued

TTGGAGCCCTTGCTGGGAGTGTTCCAAGGCCATCCGCGAGTTCCTGTCTCAGCAC

CCTAACGTGACCCTGGTCATCTACGTGGCCCGGCTGTTTCAACACATGGACCAGC

AGAACAGGCAGGGCCTGCGCGATCTGGTGAATTCTGGCGTGACCATCCAGATCA

TGACAGCCTCAGAGTACGACCATTGCTGGCGGAACTTCGTGAATTATCCACCTGG

CAAGGAGGCACACTGGCCAAGATACCCACCCCTGTGGATGAAGCTGTATGCACT

GGAGCTGCACGCAGGAATCCTGGGCCTGCCTCCATGTCTGAATATCCTGCGGAGA

AAGCAGCCCCAGCTGACATTTTTCACTATCGCACTGCAGAGCTGTCATTACCAGA

GACTGCCTCCTCATATCCTGTGGGCTACAGGCCTTAAA

Anc686 APOBEC:

(SEQ ID NO: 40)
AGCAGCGAGACAGGACCCGTGGCAGTGGACCCTACACTGAGGAGG

AGGATTGAGCCCGAATTTTTCAACAGGAACTACGACCCCAGAGAGCTGCGGAAG

GAGACATACCTGCTGTATGAGATCAAGTGGGGCAAGGAGTCCAAGATCTGGCGG

CACACCTCTAACAATAGAACACAGCACGCCGAGGTGAACTTCCTGGAGAACTTC

TTTAATGAGCTGTACTTTAATCCTTCTACCCACTGCAGCATCACATGGTTCCTGAG

CTGGTCCCCATGCGGCGAGTGTTCTAAGGCCATCGTGGAGTTTCTGAAGGAGCAC

CCCAACGTGAATCTGGAGATCTACGTGGCCAGGCTGTATCTGTGCGAGGACGAG

AGGAACAGGCAGGGCCTGCGGGATCTGGTGAATAGCGGCGTGACCATCAGAATC

ATGAACCTGCCTGACTACAATTATTGTTGGCGCACATTCGTGTCCCACCAGGGAG

GCGACGAGGATTATTGGCCAAGGCACTTTGCACCATGGGTGCGCCTGTACGTGCT

GGAGCTGTATTGCATCATCCTGGGCCTGCCCCCTTGTCTGAACATCCTGCGGAGA

AAGCAGCCCCAGCTGACATTCTTCACCATCGCACTGCAGAGTTGTCATTACCAGC

GACTGCCTCCTCATATCCTGTGGGCTACAGGCCTTAAA

Anc655 APOBEC:

(SEQ ID NO: 41)
TCATCAGAGACCGGACCTGTGGCAGTGGACCCAACCCTGCGACGG

AGAATCGAGCCCTTTTACTTTCAGTTCAACAACGACCCAAGAGCCTGCCGGAGAA

AGACCTACCTGTGCTATGAGCTGAAGCAGGACGGCTCTACCTGGGTGTGGAAGC

GGACACTGCACAACAAGGGCAGACACGCCGAGATCTGCTTCCTGGAGAAGATCA

GCTCCCTGGAGAAGCTGGACCCTGCCCAGCACTACAGGATCACATGGTATATGTC

TTGGAGCCCATGCTCCAACTGTGCCCAGAAGATCGTGGATTTTCTGAAGGAGCAC

CCACACGTGAATCTGCGGATCTACGTGGCCAGACTGTACTATCACGAGGAGGAG

AGGTATCAGGAGGGCCTGAGGAACCTGAGGCGCTCCGGCGTGTCTATCAGAGTG

ATGGACCTGCCCGATTTCGAGCACTGCTGGGAGACATTCGTGGATAACGGAGGA

GGACCTTTCCAGCCATGGCCCGGCCTGGAGGAGCTGAATAGCAAGCAGCTGTCC

CGGAGACTGCAGGCAGGAATCCTGGGCCTGCCCCCTTGTCTGAATATCCTGAGGC

GCAAGCAGCCCCAGCTGACATTTTTCACCATCGCACTGCAGAGTTGTCATTATCA

GCGACTGCCTCCTCATATCCTGTGGGCTACAGGCCTTAAA

Anc733 APOBEC:

(SEQ ID NO: 42)
AGCAGCGAGACCGGACCTGTGGCAGTGGACCCAACCCTGAGAAGA

CGCATTGAGCCATTTCATTTTCAGTTTAACAACGACCCCAGAGCCTACCGGAGAA

AGACCTACCTGTGCTATGAGCTGAAGCAGGACGGCTCCACCTGGGTGCTGGATC

GGACACTGAGAAACAAGGGCCGGCACGCCGAGATCTGTTTCCTGGACAAGATCA

```
                                                  -continued
ATTCCTGGGAGAGGCTGGATCCCGCCCAGCACTACCGCGTGACATGGTATATGA

GCTGGTCCCCTTGCTCTAACTGTGCCCAGCAGGTGGTGGATTTCCTGAAGGAGCA

CCCACACGTGAATCTGCGGATCTTTGCCGCCAGACTGTACTATCACGAGCAGAGG

CGCTATCAGGAGGGCCTGCGGAGCCTGAGGGGAAGCGGAGTGCCTGTGGCCGTG

ATGACCCTGCCAGACTTCGAGCACTGCTGGGAGACATTTGTGGATCACGGCGGCC

GGCCATTCCAGCCATGGGACGGCCTGGAGGAGCTGAACTCTAGGAGCCTGTCCC

GGAGACTGCAGGCAGGAATCCTGGGCCTGCCCCCTTGTCTGAATATCCTGAGGCG

CAAGCAGCCCCAGCTGACCTTTTTTACCATCGCACTGCAGAGTTGTCACTACCAG

AGACTGCCTCCTCATATCCTGTGGGCTACAGGCCTTAAA

TadA WT:
                                                                 (SEQ ID NO: 43)
TCTGAAGTCGAGTTTAGCCACGAGTATTGGATGAGGCACGCACTGA

CCCTGGCAAAGCGAGCATGGGATGAAAGAGAAGTCCCCGTGGGCGCCGTGCTGG

TGCACAACAATAGAGTGATCGGAGAGGGATGGAACAGGCCAATCGGCCGCCACG

ACCCTACCGCACACGCAGAGATCATGGCACTGAGGCAGGGAGGCCTGGTCATGC

AGAATTACCGCCTGATCGATGCCACCCTGTATGTGACACTGGAGCCATGCGTGAT

GTGCGCAGGAGCAATGATCCACAGCAGGATCGGAAGAGTGGTGTTCGGAGCACG

GGACGCCAAGACCGGCGCAGCAGGCTCCCTGATGGATGTGCTGCACCACCCCGG

CATGAACCACCGGGTGGAGATCACAGAGGGAATCCTGGCAGACGAGTGCGCCGC

CCTGCTGAGCGATTTCTTTAGAATGCGGAGACAGGAGATCAAGGCCCAGAAGAA

GGCACAGAGCTCCACCGAC

TadA 7.10:
                                                                 (SEQ ID NO: 44)
TCTGAGGTGGAGTTTTCCCACGAGTACTGGATGAGACATGCCCTGA

CCCTGGCCAAGAGGGCACGCGATGAGAGGGAGGTGCCTGTGGGAGCCGTGCTGG

TGCTGAACAATAGAGTGATCGGCGAGGGCTGGAACAGAGCCATCGGCCTGCACG

ACCCAACAGCCCATGCCGAAATTATGGCCCTGAGACAGGGCGGCCTGGTCATGC

AGAACTACAGACTGATTGACGCCACCCTGTACGTGACATTCGAGCCTTGCGTGAT

GTGCGCCGGCGCCATGATCCACTCTAGGATCGGCCGCGTGGTGTTTGGCGTGAGG

AACGCAAAAACCGGCGCCGCAGGCTCCCTGATGGACGTGCTGCACTACCCCGGC

ATGAATCACCGCGTCGAAATTACCGAGGGAATCCTGGCAGATGAATGTGCCGCC

CTGCTGTGCTATTTCTTTCGGATGCCTAGACAGGTGTTCAATGCTCAGAAGAAGG

CCCAGAGCTCCACCGAC

BE4max:
                                                                 (SEQ ID NO: 45)
ATGAAACGGACAGCCGACGGAAGCGAGTTCGAGTCACCAAAGAAG

AAGCGGAAAGTCTCCTCAGAGACTGGGCCTGTCGCCGTCGATCCAACCCTGCGC

CGCCGGATTGAACCTCACGAGTTTGAAGTGTTCTTTGACCCCCGGGAGCTGAGAA

AGGAGACATGCCTGCTGTACGAGATCAACTGGGGAGGCAGGCACTCCATCTGGA

GGCACACCTCTCAGAACACAAATAAGCACGTGGAGGTGAACTTCATCGAGAAGT

TTACCACAGAGCGGTACTTCTGCCCCAATACCAGATGTAGCATCACATGGTTTCT

GAGCTGGTCCCCTTGCGGAGAGTGTAGCAGGGCCATCACCGAGTTCCTGTCCAGA

TATCCACACGTGACACTGTTTATCTACATCGCCAGGCTGTATCACCACGCAGACC
```

-continued

```
CAAGGAATAGGCAGGGCCTGCGCGATCTGATCAGCTCCGGCGTGACCATCCAGA
TCATGACAGAGCAGGAGTCCGGCTACTGCTGGCGGAACTTCGTGAATTATTCTCC
TAGCAACGAGGCCCACTGGCCTAGGTACCCACACCTGTGGGTGCGCCTGTACGT
GCTGGAGCTGTATTGCATCATCCTGGGCCTGCCCCCTTGTCTGAATATCCTGCGG
AGAAAGCAGCCCCAGCTGACCTTCTTTACAATCGCCCTGCAGTCTTGTCACTATC
AGAGGCTGCCACCCCACATCCTGTGGGCCACAGGCCTGAAGTCTGGAGGATCTA
GCGGAGGATCCTCTGGCAGCGAGACACCAGGAACAAGCGAGTCAGCAACACCA
GAGAGCAGTGGCGGCAGCAGCGGCGGCAGCGACAAGAAGTACAGCATCGGCCT
GGACATCGGCACCAACTCTGTGGGCTGGGCCGTGATCACCGACGAGTACAAGGT
GCCCAGCAAGAAATTCAAGGTGCTGGGCAACACCGACCGGCACAGCATCAAGAA
GAACCTGATCGGAGCCCTGCTGTTCGACAGCGGCGAAACAGCCGAGGCCACCCG
GCTGAAGAGAACCGCCAGAAGAAGATACACCAGACGGAAGAACCGGATCTGCT
ATCTGCAAGAGATCTTCAGCAACGAGATGGCCAAGGTGGACGACAGCTTCTTCC
ACAGACTGGAAGAGTCCTTCCTGGTGGAAGAGGATAAGAAGCACGAGCGGCACC
CCATCTTCGGCAACATCGTGGACGAGGTGGCCTACCACGAGAAGTACCCCACCA
TCTACCACCTGAGAAAGAAACTGGTGGACAGCACCGACAAGGCCGACCTGCGGC
TGATCTATCTGGCCCTGGCCCACATGATCAAGTTCCGGGGCCACTTCCTGATCGA
GGGCGACCTGAACCCCGACAACAGCGACGTGGACAAGCTGTTCATCCAGCTGGT
GCAGACCTACAACCAGCTGTTCGAGGAAAACCCCATCAACGCCAGCGGCGTGGA
CGCCAAGGCCATCCTGTCTGCCAGACTGAGCAAGAGCAGACGGCTGGAAAATCT
GATCGCCCAGCTGCCCGGCGAGAAGAAGAATGGCCTGTTCGGAAACCTGATTGC
CCTGAGCCTGGGCCTGACCCCCAACTTCAAGAGCAACTTCGACCTGGCCGAGGA
TGCCAAACTGCAGCTGAGCAAGGACACCTACGACGACGACCTGGACAACCTGCT
GGCCCAGATCGGCGACCAGTACGCCGACCTGTTTCTGGCCGCCAAGAACCTGTCC
GACGCCATCCTGCTGAGCGACATCCTGAGAGTGAACACCGAGATCACCAAGGCC
CCCCTGAGCGCCTCTATGATCAAGAGATACGACGAGCACCACCAGGACCTGACC
CTGCTGAAAGCTCTCGTGCGGCAGCAGCTGCCTGAGAAGTACAAAGAGATTTTCT
TCGACCAGAGCAAGAACGGCTACGCCGGCTACATTGACGGCGGAGCCAGCCAGG
AAGAGTTCTACAAGTTCATCAAGCCCATCCTGGAAAAGATGGACGGCACCGAGG
AACTGCTCGTGAAGCTGAACAGAGAGGACCTGCTGCGGAAGCAGCGGACCTTCG
ACAACGGCAGCATCCCCCACCAGATCCACCTGGGAGAGCTGCACGCCATTCTGC
GGCGGCAGGAAGATTTTTACCCATTCCTGAAGGACAACCGGGAAAAGATCGAGA
AGATCCTGACCTTCCGCATCCCCTACTACGTGGGCCCTCTGGCCAGGGGAAACAG
CAGATTCGCCTGGATGACCAGAAAGAGCGAGGAAACCATCACCCCCTGGAACTT
CGAGGAAGTGGTGGACAAGGGCGCTTCCGCCCAGAGCTTCATCGAGCGGATGAC
CAACTTCGATAAGAACCTGCCCAACGAGAAGGTGCTGCCCAAGCACAGCCTGCT
GTACGAGTACTTCACCGTGTATAACGAGCTGACCAAAGTGAAATACGTGACCGA
GGGAATGAGAAAGCCCGCCTTCCTGAGCGGCGAGCAGAAAAAGGCCATCGTGGA
CCTGCTGTTCAAGACCAACCGGAAAGTGACCGTGAAGCAGCTGAAAGAGGACTA
CTTCAAGAAAATCGAGTGCTTCGACTCCGTGGAAATCTCCGGCGTGGAAGATCG
GTTCAACGCCTCCCTGGGCACATACCACGATCTGCTGAAAATTATCAAGGACAAG
```

-continued

```
GACTTCCTGGACAATGAGGAAAACGAGGACATTCTGGAAGATATCGTGCTGACC
CTGACACTGTTTGAGGACAGAGAGATGATCGAGGAACGGCTGAAAACCTATGCC
CACCTGTTCGACGACAAAGTGATGAAGCAGCTGAAGCGGCGGAGATACACCGGC
TGGGGCAGGCTGAGCCGGAAGCTGATCAACGGCATCCGGGACAAGCAGTCCGGC
AAGACAATCCTGGATTTCCTGAAGTCCGACGGCTTCGCCAACAGAAACTTCATGC
AGCTGATCCACGACGACAGCCTGACCTTTAAAGAGGACATCCAGAAAGCCCAGG
TGTCCGGCCAGGGCGATAGCCTGCACGAGCACATTGCCAATCTGGCCGGCAGCC
CCGCCATTAAGAAGGGCATCCTGCAGACAGTGAAGGTGGTGGACGAGCTCGTGA
AAGTGATGGGCCGGCACAAGCCCGAGAACATCGTGATCGAAATGGCCAGAGAG
AACCAGACCACCCAGAAGGGACAGAAGAACAGCCGCGAGAGAATGAAGCGGAT
CGAAGAGGGCATCAAAGAGCTGGGCAGCCAGATCCTGAAAGAACACCCCGTGG
AAAACACCCAGCTGCAGAACGAGAAGCTGTACCTGTACTACCTGCAGAATGGGC
GGGATATGTACGTGGACCAGGAACTGGACATCAACCGGCTGTCCGACTACGATG
TGGACCATATCGTGCCTCAGAGCTTTCTGAAGGACGACTCCATCGACAACAAGGT
GCTGACCAGAAGCGACAAGAACCGGGGCAAGAGCGACAACGTGCCCTCCGAAG
AGGTCGTGAAGAAGATGAAGAACTACTGGCGGCAGCTGCTGAACGCCAAGCTGA
TTACCCAGAGAAAGTTCGACAATCTGACCAAGGCCGAGAGAGGCGGCCTGAGCG
AACTGGATAAGGCCGGCTTCATCAAGAGACAGCTGGTGGAAACCCGGCAGATCA
CAAAGCACGTGGCACAGATCCTGGACTCCCGGATGAACACTAAGTACGACGAGA
ATGACAAGCTGATCCGGGAAGTGAAAGTGATCACCCTGAAGTCCAAGCTGGTGT
CCGATTTCCGGAAGGATTTCCAGTTTTACAAAGTGCGCGAGATCAACAACTACCA
CCACGCCCACGACGCCTACCTGAACGCCGTCGTGGGAACCGCCCTGATCAAAAA
GTACCCTAAGCTGGAAAGCGAGTTCGTGTACGGCGACTACAAGGTGTACGACGT
GCGGAAGATGATCGCCAAGAGCGAGCAGGAAATCGGCAAGGCTACCGCCAAGT
ACTTCTTCTACAGCAACATCATGAACTTTTTCAAGACCGAGATTACCCTGGCCAA
CGGCGAGATCCGGAAGCGGCCTCTGATCGAGACAAACGGCGAAACCGGGGAGA
TCGTGTGGGATAAGGGCCGGGATTTTGCCACCGTGCGGAAAGTGCTGAGCATGC
CCCAAGTGAATATCGTGAAAAAGACCGAGGTGCAGACAGGCGGCTTCAGCAAAG
AGTCTATCCTGCCCAAGAGGAACAGCGATAAGCTGATCGCCAGAAAGAAGGACT
GGGACCCTAAGAAGTACGGCGGCTTCGACAGCCCCACCGTGGCCTATTCTGTGCT
GGTGGTGGCCAAAGTGGAAAAGGGCAAGTCCAAGAAACTGAAGAGTGTGAAAG
AGCTGCTGGGGATCACCATCATGGAAAGAAGCAGCTTCGAGAAGAATCCCATCG
ACTTTCTGGAAGCCAAGGGCTACAAAGAAGTGAAAAAGGACCTGATCATCAAGC
TGCCTAAGTACTCCCTGTTCGAGCTGGAAAACGGCCGGAAGAGAATGCTGGCCT
CTGCCGGCGAACTGCAGAAGGGAAACGAACTGGCCCTGCCCTCCAAATATGTGA
ACTTCCTGTACCTGGCCAGCCACTATGAGAAGCTGAAGGGCTCCCCCGAGGATA
ATGAGCAGAAACAGCTGTTTGTGGAACAGCACAAGCACTACCTGGACGAGATCA
TCGAGCAGATCAGCGAGTTCTCCAAGAGAGTGATCCTGGCCGACGCTAATCTGG
ACAAAGTGCTGTCCGCCTACAACAAGCACCGGGATAAGCCCATCAGAGAGCAGG
CCGAGAATATCATCCACCTGTTTACCCTGACCAATCTGGGAGCCCCTGCCGCCTT
```

-continued

CAAGTACTTTGACACCACCATCGACCGGAAGAGGTACACCAGCACCAAAGAGGT

GCTGGACGCCACCCTGATCCACCAGAGCATCACCGGCCTGTACGAGACACGGAT

CGACCTGTCTCAGCTGGGAGGTGACAGCGGCGGGAGCGGCGGGAGCGGGGGGA

GCACTAATCTGAGCGACATCATTGAGAAGGAGACTGGGAAACAGCTGGTCATTC

AGGAGTCCATCCTGATGCTGCCTGAGGAGGTGGAGGAAGTGATCGGCAACAAGC

CAGAGTCTGACATCCTGGTGCACACCGCCTACGACGAGTCCACAGATGAGAATG

TGATGCTGCTGACCTCTGACGCCCCCGAGTATAAGCCTTGGGCCCTGGTCATCCA

GGATTCTAACGGCGAGAATAAGATCAAGATGCTGAGCGGAGGATCCGGAGGATC

TGGAGGCAGCACCAACCTGTCTGACATCATCGAGAAGGAGACAGGCAAGCAGCT

GGTCATCCAGGAGAGCATCCTGATGCTGCCCGAAGAAGTCGAAGAAGTGATCGG

AAACAAGCCTGAGAGCGATATCCTGGTCCATACCGCCTACGACGAGAGTACCGA

CGAAAATGTGATGCTGCTGACATCCGACGCCCCAGAGTATAAGCCCTGGGCTCTG

GTCATCCAGGATTCCAACGGAGAGAACAAAATCAAAATGCTGTCTGGCGGCTCA

AAAAGAACCGCCGACGGCAGCGAATTCGAGCCCAAGAAGAAGAGGAAAGTC

AncBE4max689:
(SEQ ID NO: 46)
ATGAAACGGACAGCCGACGGAAGCGAGTTCGAGTCACCAAAGAAG

AAGCGGAAAGTCAGCAGTGAAACCGGACCAGTGGCAGTGGACCCAACCCTGAG

GAGACGGATTGAGCCCCATGAATTTGAAGTGTTCTTTGACCCAAGGGAGCTGAG

GAAGGAGACATGCCTGCTGTACGAGATCAAGTGGGGCACAAGCCACAAGATCTG

GCGCCACAGCTCCAAGAACACCACAAAGCACGTGGAAGTGAATTTCATCGAGAA

GTTTACCTCCGAGCGGCACTTCTGCCCCTCTACCAGCTGTTCCATCACATGGTTTC

TGTCTTGGAGCCCTTGCGGCGAGTGTTCCAAGGCCATCACCGAGTTCCTGTCTCA

GCACCCTAACGTGACCCTGGTCATCTACGTGGCCCGGCTGTATCACCACATGGAC

CAGCAGAACAGGCAGGGCCTGCGCGATCTGGTGAATTCTGGCGTGACCATCCAG

ATCATGACAGCCCCAGAGTACGACTATTGCTGGCGGAACTTCGTGAATTATCCAC

CTGGCAAGGAGGCACACTGGCCAAGATACCCACCCCTGTGGATGAAGCTGTATG

CACTGGAGCTGCACGCAGGAATCCTGGGCCTGCCTCCATGTCTGAATATCCTGCG

GAGAAAGCAGCCCCAGCTGACATTTTTCACCATTGCTCTGCAGTCTTGTCACTAT

CAGCGGCTGCCTCCTCATATTCTGTGGGCTACAGGCCTTAAATCTGGAGGATCTA

GCGGAGGATCCTCTGGCAGCGAGACACCAGGAACAAGCGAGTCAGCAACACCA

GAGAGCAGTGGCGGCAGCAGCGGCGGCAGCGACAAGAAGTACAGCATCGGCCT

GGACATCGGCACCAACTCTGTGGGCTGGGCCGTGATCACCGACGAGTACAAGGT

GCCCAGCAAGAAATTCAAGGTGCTGGGCAACACCGACCGGCACAGCATCAAGAA

GAACCTGATCGGAGCCCTGCTGTTCGACAGCGGCGAAACAGCCGAGGCCACCCG

GCTGAAGAGAACCGCCAGAAGAAGATACACCAGACGGAAGAACCGGATCTGCT

ATCTGCAAGAGATCTTCAGCAACGAGATGGCCAAGGTGGACGACAGCTTCTTCC

ACAGACTGGAAGAGTCCTTCCTGGTGGAAGAGGATAAGAAGCACGAGCGGCACC

CCATCTTCGGCAACATCGTGGACGAGGTGGCCTACCACGAGAAGTACCCCACCA

TCTACCACCTGAGAAAGAAACTGGTGGACAGCACCGACAAGGCCGACCTGCGGC

TGATCTATCTGGCCCTGGCCCACATGATCAAGTTCCGGGGCCACTTCCTGATCGA

GGGCGACCTGAACCCCGACAACAGCGACGTGGACAAGCTGTTCATCCAGCTGGT

-continued

```
GCAGACCTACAACCAGCTGTTCGAGGAAAACCCCATCAACGCCAGCGGCGTGGA
CGCCAAGGCCATCCTGTCTGCCAGACTGAGCAAGAGCAGACGGCTGGAAAATCT
GATCGCCCAGCTGCCCGGCGAGAAGAAGAATGGCCTGTTCGGAAACCTGATTGC
CCTGAGCCTGGGCCTGACCCCCAACTTCAAGAGCAACTTCGACCTGGCCGAGGA
TGCCAAACTGCAGCTGAGCAAGGACACCTACGACGACGACCTGGACAACCTGCT
GGCCCAGATCGGCGACCAGTACGCCGACCTGTTTCTGGCCGCCAAGAACCTGTCC
GACGCCATCCTGCTGAGCGACATCCTGAGAGTGAACACCGAGATCACCAAGGCC
CCCCTGAGCGCCTCTATGATCAAGAGATACGACGAGCACCACCAGGACCTGACC
CTGCTGAAAGCTCTCGTGCGGCAGCAGCTGCCTGAGAAGTACAAAGAGATTTTCT
TCGACCAGAGCAAGAACGGCTACGCCGGCTACATTGACGGCGGAGCCAGCCAGG
AAGAGTTCTACAAGTTCATCAAGCCCATCCTGGAAAAGATGGACGGCACCGAGG
AACTGCTCGTGAAGCTGAACAGAGAGGACCTGCTGCGGAAGCAGCGGACCTTCG
ACAACGGCAGCATCCCCCACCAGATCCACCTGGGAGAGCTGCACGCCATTCTGC
GGCGGCAGGAAGATTTTTACCCATTCCTGAAGGACAACCGGGAAAAGATCGAGA
AGATCCTGACCTTCCGCATCCCCTACTACGTGGGCCCTCTGGCCAGGGGAAACAG
CAGATTCGCCTGGATGACCAGAAAGAGCGAGGAAACCATCACCCCCTGGAACTT
CGAGGAAGTGGTGGACAAGGGCGCTTCCGCCCAGAGCTTCATCGAGCGGATGAC
CAACTTCGATAAGAACCTGCCCAACGAGAAGGTGCTGCCCAAGCACAGCCTGCT
GTACGAGTACTTCACCGTGTATAACGAGCTGACCAAAGTGAAATACGTGACCGA
GGGAATGAGAAAGCCCGCCTTCCTGAGCGGCGAGCAGAAAAAGGCCATCGTGGA
CCTGCTGTTCAAGACCAACCGGAAAGTGACCGTGAAGCAGCTGAAAGAGGACTA
CTTCAAGAAAATCGAGTGCTTCGACTCCGTGGAAATCTCCGGCGTGGAAGATCG
GTTCAACGCCTCCCTGGGCACATACCACGATCTGCTGAAAATTATCAAGGACAAG
GACTTCCTGGACAATGAGGAAAACGAGGACATTCTGGAAGATATCGTGCTGACC
CTGACACTGTTTGAGGACAGAGAGATGATCGAGGAACGGCTGAAAACCTATGCC
CACCTGTTCGACGACAAAGTGATGAAGCAGCTGAAGCGGCGGAGATACACCGGC
TGGGGCAGGCTGAGCCGGAAGCTGATCAACGGCATCCGGGACAAGCAGTCCGGC
AAGACAATCCTGGATTTCCTGAAGTCCGACGGCTTCGCCAACAGAAACTTCATGC
AGCTGATCCACGACGACAGCCTGACCTTTAAAGAGGACATCCAGAAAGCCCAGG
TGTCCGGCCAGGGCGATAGCCTGCACGAGCACATTGCCAATCTGGCCGGCAGCC
CCGCCATTAAGAAGGGCATCCTGCAGACAGTGAAGGTGGTGGACGAGCTCGTGA
AAGTGATGGGCCGGCACAAGCCCGAGAACATCGTGATCGAAATGGCCAGAGAG
AACCAGACCACCCAGAAGGGACAGAAGAACAGCCGCGAGAGAATGAAGCGGAT
CGAAGAGGGCATCAAAGAGCTGGGCAGCCAGATCCTGAAAGAACACCCCGTGG
AAAACACCCAGCTGCAGAACGAGAAGCTGTACCTGTACTACCTGCAGAATGGGC
GGGATATGTACGTGGACCAGGAACTGGACATCAACCGGCTGTCCGACTACGATG
TGGACCATATCGTGCCTCAGAGCTTTCTGAAGGACGACTCCATCGACAACAAGGT
GCTGACCAGAAGCGACAAGAACCGGGGCAAGAGCGACAACGTGCCCTCCGAAG
AGGTCGTGAAGAAGATGAAGAACTACTGGCGGCAGCTGCTGAACGCCAAGCTGA
TTACCCAGAGAAAGTTCGACAATCTGACCAAGGCCGAGAGAGGCGGCCTGAGCG
```

-continued

```
AACTGGATAAGGCCGGCTTCATCAAGAGACAGCTGGTGGAAACCCGGCAGATCA

CAAAGCACGTGGCACAGATCCTGGACTCCCGGATGAACACTAAGTACGACGAGA

ATGACAAGCTGATCCGGGAAGTGAAAGTGATCACCCTGAAGTCCAAGCTGGTGT

CCGATTTCCGGAAGGATTTCCAGTTTTACAAAGTGCGCGAGATCAACAACTACCA

CCACGCCCACGACGCCTACCTGAACGCCGTCGTGGGAACCGCCCTGATCAAAAA

GTACCCTAAGCTGGAAAGCGAGTTCGTGTACGGCGACTACAAGGTGTACGACGT

GCGGAAGATGATCGCCAAGAGCGAGCAGGAAATCGGCAAGGCTACCGCCAAGT

ACTTCTTCTACAGCAACATCATGAACTTTTTCAAGACCGAGATTACCCTGGCCAA

CGGCGAGATCCGGAAGCGGCCTCTGATCGAGACAAACGGCGAAACCGGGGAGA

TCGTGTGGGATAAGGGCCGGGATTTTGCCACCGTGCGGAAAGTGCTGAGCATGC

CCCAAGTGAATATCGTGAAAAAGACCGAGGTGCAGACAGGCGGCTTCAGCAAAG

AGTCTATCCTGCCCAAGAGGAACAGCGATAAGCTGATCGCCAGAAAGAAGGACT

GGGACCCTAAGAAGTACGGCGGCTTCGACAGCCCCACCGTGGCCTATTCTGTGCT

GGTGGTGGCCAAAGTGGAAAAGGGCAAGTCCAAGAAACTGAAGAGTGTGAAAG

AGCTGCTGGGGATCACCATCATGGAAAGAAGCAGCTTCGAGAAGAATCCCATCG

ACTTTCTGGAAGCCAAGGGCTACAAAGAAGTGAAAAAGGACCTGATCATCAAGC

TGCCTAAGTACTCCCTGTTCGAGCTGGAAAACGGCCGGAAGAGAATGCTGGCCT

CTGCCGGCGAACTGCAGAAGGGAAACGAACTGGCCCTGCCCTCCAAATATGTGA

ACTTCCTGTACCTGGCCAGCCACTATGAGAAGCTGAAGGGCTCCCCCGAGGATA

ATGAGCAGAAACAGCTGTTTGTGGAACAGCACAAGCACTACCTGGACGAGATCA

TCGAGCAGATCAGCGAGTTCTCCAAGAGAGTGATCCTGGCCGACGCTAATCTGG

ACAAAGTGCTGTCCGCCTACAACAAGCACCGGGATAAGCCCATCAGAGAGCAGG

CCGAGAATATCATCCACCTGTTTACCCTGACCAATCTGGGAGCCCCTGCCGCCTT

CAAGTACTTTGACACCACCATCGACCGGAAGAGGTACACCAGCACCAAAGAGGT

GCTGGACGCCACCCTGATCCACCAGAGCATCACCGGCCTGTACGAGACACGGAT

CGACCTGTCTCAGCTGGGAGGTGACAGCGGCGGGAGCGGCGGGAGCGGGGGA

GCACTAATCTGAGCGACATCATTGAGAAGGAGACTGGGAAACAGCTGGTCATTC

AGGAGTCCATCCTGATGCTGCCTGAGGAGGTGGAGGAAGTGATCGGCAACAAGC

CAGAGTCTGACATCCTGGTGCACACCGCCTACGACGAGTCCACAGATGAGAATG

TGATGCTGCTGACCTCTGACGCCCCCGAGTATAAGCCTTGGGCCCTGGTCATCCA

GGATTCTAACGGCGAGAATAAGATCAAGATGCTGAGCGGAGGATCCGGAGGATC

TGGAGGCAGCACCAACCTGTCTGACATCATCGAGAAGGAGACAGGCAAGCAGCT

GGTCATCCAGGAGAGCATCCTGATGCTGCCCGAAGAAGTCGAAGAAGTGATCGG

AAACAAGCCTGAGAGCGATATCCTGGTCCATACCGCCTACGACGAGAGTACCGA

CGAAAATGTGATGCTGCTGACATCCGACGCCCCAGAGTATAAGCCCTGGGCTCTG

GTCATCCAGGATTCCAACGGAGAGAACAAAATCAAAATGCTGTCTGGCGGCTCA

AAAAGAACCGCCGACGGCAGCGAATTCGAGCCCAAGAAGAAGAGGAAAGTC
```

AncBE4max687:
(SEQ ID NO: 47)
```
ATGAAACGGACAGCCGACGGAAGCGAGTTCGAGTCACCAAAGAAG

AAGCGGAAAGTCTCATCAGAAACAGGACCAGTCGCCGTGGACCCAACACTGAGG

AGAAGGATTGAGCCCCATGAATTTGAAGTCTTTTTCGACCCCAGGGAGCTGAGG
```

-continued

```
AAGGAGGCATGCCTGCTGTACGAGATCAAGTGGGGCACAAGCCACAAGATCTGG

CGCAACAGCGGCAAGAACACCACAAAGCACGTGGAAGTGAATTTCATCGAGAAG

TTTACCTCCGAGCGGCACTTCTGCCCCTCTATCAGCTGTTCCATCACATGGTTTCT

GTCTTGGAGCCCTTGCTGGGAGTGTTCCAAGGCCATCCGCGAGTTCCTGTCTCAG

CACCCTAACGTGACCCTGGTCATCTACGTGGCCCGGCTGTTTCAACACATGGACC

AGCAGAACAGGCAGGGCCTGCGCGATCTGGTGAATTCTGGCGTGACCATCCAGA

TCATGACAGCCTCAGAGTACGACCATTGCTGGCGGAACTTCGTGAATTATCCACC

TGGCAAGGAGGCACACTGGCCAAGATACCCACCCCTGTGGATGAAGCTGTATGC

ACTGGAGCTGCACGCAGGAATCCTGGGCCTGCCTCCATGTCTGAATATCCTGCGG

AGAAAGCAGCCCCAGCTGACATTTTTCACTATCGCACTGCAGAGCTGTCATTACC

AGAGACTGCCTCCTCATATCCTGTGGGCTACAGGCCTTAAATCTGGAGGATCTAG

CGGAGGATCCTCTGGCAGCGAGACACCAGGAACAAGCGAGTCAGCAACACCAG

AGAGCAGTGGCGGCAGCAGCGGCGGCAGCGACAAGAAGTACAGCATCGGCCTG

GACATCGGCACCAACTCTGTGGGCTGGGCCGTGATCACCGACGAGTACAAGGTG

CCCAGCAAGAAATTCAAGGTGCTGGGCAACACCGACCGGCACAGCATCAAGAAG

AACCTGATCGGAGCCCTGCTGTTCGACAGCGGCGAAACAGCCGAGGCCACCCGG

CTGAAGAGAACCGCCAGAAGAAGATACACCAGACGGAAGAACCGGATCTGCTAT

CTGCAAGAGATCTTCAGCAACGAGATGGCCAAGGTGGACGACAGCTTCTTCCAC

AGACTGGAAGAGTCCTTCCTGGTGGAAGAGGATAAGAAGCACGAGCGGCACCCC

ATCTTCGGCAACATCGTGGACGAGGTGGCCTACCACGAGAAGTACCCCACCATC

TACCACCTGAGAAAGAAACTGGTGGACAGCACCGACAAGGCCGACCTGCGGCTG

ATCTATCTGGCCCTGGCCCACATGATCAAGTTCCGGGGCCACTTCCTGATCGAGG

GCGACCTGAACCCCGACAACAGCGACGTGGACAAGCTGTTCATCCAGCTGGTGC

AGACCTACAACCAGCTGTTCGAGGAAAACCCCATCAACGCCAGCGGCGTGGACG

CCAAGGCCATCCTGTCTGCCAGACTGAGCAAGAGCAGACGGCTGGAAAATCTGA

TCGCCCAGCTGCCCGGCGAGAAGAAGAATGGCCTGTTCGGAAACCTGATTGCCC

TGAGCCTGGGCCTGACCCCCAACTTCAAGAGCAACTTCGACCTGGCCGAGGATG

CCAAACTGCAGCTGAGCAAGGACACCTACGACGACGACCTGGACAACCTGCTGG

CCCAGATCGGCGACCAGTACGCCGACCTGTTTCTGGCCGCCAAGAACCTGTCCGA

CGCCATCCTGCTGAGCGACATCCTGAGAGTGAACACCGAGATCACCAAGGCCCC

CCTGAGCGCCTCTATGATCAAGAGATACGACGAGCACCACCAGGACCTGACCCT

GCTGAAAGCTCTCGTGCGGCAGCAGCTGCCTGAGAAGTACAAAGAGATTTTCTTC

GACCAGAGCAAGAACGGCTACGCCGGCTACATTGACGGCGGAGCCAGCCAGGA

AGAGTTCTACAAGTTCATCAAGCCCATCCTGGAAAAGATGGACGGCACCGAGGA

ACTGCTCGTGAAGCTGAACAGAGAGGACCTGCTGCGGAAGCAGCGGACCTTCGA

CAACGGCAGCATCCCCCACCAGATCCACCTGGGAGAGCTGCACGCCATTCTGCG

GCGGCAGGAAGATTTTTACCCATTCCTGAAGGACAACCGGGAAAAGATCGAGAA

GATCCTGACCTTCCGCATCCCCTACTACGTGGGCCCTCTGGCCAGGGGAAACAGC

AGATTCGCCTGGATGACCAGAAAGAGCGAGGAAACCATCACCCCCTGGAACTTC

GAGGAAGTGGTGGACAAGGGCGCTTCCGCCCAGAGCTTCATCGAGCGGATGACC
```

-continued
```
AACTTCGATAAGAACCTGCCCAACGAGAAGGTGCTGCCCAAGCACAGCCTGCTG

TACGAGTACTTCACCGTGTATAACGAGCTGACCAAAGTGAAATACGTGACCGAG

GGAATGAGAAAGCCCGCCTTCCTGAGCGGCGAGCAGAAAAAGGCCATCGTGGAC

CTGCTGTTCAAGACCAACCGGAAAGTGACCGTGAAGCAGCTGAAAGAGGACTAC

TTCAAGAAAATCGAGTGCTTCGACTCCGTGGAAATCTCCGGCGTGGAAGATCGGT

TCAACGCCTCCCTGGGCACATACCACGATCTGCTGAAAATTATCAAGGACAAGG

ACTTCCTGGACAATGAGGAAAACGAGGACATTCTGGAAGATATCGTGCTGACCC

TGACACTGTTTGAGGACAGAGAGATGATCGAGGAACGGCTGAAAACCTATGCCC

ACCTGTTCGACGACAAAGTGATGAAGCAGCTGAAGCGGCGGAGATACACCGGCT

GGGGCAGGCTGAGCCGGAAGCTGATCAACGGCATCCGGGACAAGCAGTCCGGC

AAGACAATCCTGGATTTCCTGAAGTCCGACGGCTTCGCCAACAGAAACTTCATGC

AGCTGATCCACGACGACAGCCTGACCTTTAAAGAGGACATCCAGAAAGCCCAGG

TGTCCGGCCAGGGCGATAGCCTGCACGAGCACATTGCCAATCTGGCCGGCAGCC

CCGCCATTAAGAAGGGCATCCTGCAGACAGTGAAGGTGGTGGACGAGCTCGTGA

AAGTGATGGGCCGGCACAAGCCCGAGAACATCGTGATCGAAATGGCCAGAGAG

AACCAGACCACCCAGAAGGGACAGAAGAACAGCCGCGAGAGAATGAAGCGGAT

CGAAGAGGGCATCAAAGAGCTGGGCAGCCAGATCCTGAAAGAACACCCCGTGG

AAAACACCCAGCTGCAGAACGAGAAGCTGTACCTGTACTACCTGCAGAATGGGC

GGGATATGTACGTGGACCAGGAACTGGACATCAACCGGCTGTCCGACTACGATG

TGGACCATATCGTGCCTCAGAGCTTTCTGAAGGACGACTCCATCGACAACAAGGT

GCTGACCAGAAGCGACAAGAACCGGGGCAAGAGCGACAACGTGCCCTCCGAAG

AGGTCGTGAAGAAGATGAAGAACTACTGGCGGCAGCTGCTGAACGCCAAGCTGA

TTACCCAGAGAAAGTTCGACAATCTGACCAAGGCCGAGAGAGGCGGCCTGAGCG

AACTGGATAAGGCCGGCTTCATCAAGAGACAGCTGGTGGAAACCCGGCAGATCA

CAAAGCACGTGGCACAGATCCTGGACTCCCGGATGAACACTAAGTACGACGAGA

ATGACAAGCTGATCCGGGAAGTGAAAGTGATCACCCTGAAGTCCAAGCTGGTGT

CCGATTTCCGGAAGGATTTCCAGTTTTACAAAGTGCGCGAGATCAACAACTACCA

CCACGCCCACGACGCCTACCTGAACGCCGTCGTGGGAACCGCCCTGATCAAAAA

GTACCCTAAGCTGGAAAGCGAGTTCGTGTACGGCGACTACAAGGTGTACGACGT

GCGGAAGATGATCGCCAAGAGCGAGCAGGAAATCGGCAAGGCTACCGCCAAGT

ACTTCTTCTACAGCAACATCATGAACTTTTTCAAGACCGAGATTACCCTGGCCAA

CGGCGAGATCCGGAAGCGGCCTCTGATCGAGACAAACGGCGAAACCGGGGAGA

TCGTGTGGGATAAGGGCCGGGATTTTGCCACCGTGCGGAAAGTGCTGAGCATGC

CCCAAGTGAATATCGTGAAAAAGACCGAGGTGCAGACAGGCGGCTTCAGCAAAG

AGTCTATCCTGCCCAAGAGGAACAGCGATAAGCTGATCGCCAGAAAGAAGGACT

GGGACCCTAAGAAGTACGGCGGCTTCGACAGCCCCACCGTGGCCTATTCTGTGCT

GGTGGTGGCCAAAGTGGAAAAGGGCAAGTCCAAGAAACTGAAGAGTGTGAAAG

AGCTGCTGGGGATCACCATCATGGAAAGAAGCAGCTTCGAGAAGAATCCCATCG

ACTTTCTGGAAGCCAAGGGCTACAAAGAAGTGAAAAAGGACCTGATCATCAAGC

TGCCTAAGTACTCCCTGTTCGAGCTGGAAAACGGCCGGAAGAGAATGCTGGCCT

CTGCCGGCGAACTGCAGAAGGGAAACGAACTGGCCCTGCCCTCCAAATATGTGA
```

-continued

```
ACTTCCTGTACCTGGCCAGCCACTATGAGAAGCTGAAGGGCTCCCCCGAGGATA
ATGAGCAGAAACAGCTGTTTGTGGAACAGCACAAGCACTACCTGGACGAGATCA
TCGAGCAGATCAGCGAGTTCTCCAAGAGAGTGATCCTGGCCGACGCTAATCTGG
ACAAAGTGCTGTCCGCCTACAACAAGCACCGGGATAAGCCCATCAGAGAGCAGG
CCGAGAATATCATCCACCTGTTTACCCTGACCAATCTGGGAGCCCCTGCCGCCTT
CAAGTACTTTGACACCACCATCGACCGGAAGAGGTACACCAGCACCAAAGAGGT
GCTGGACGCCACCCTGATCCACCAGAGCATCACCGGCCTGTACGAGACACGGAT
CGACCTGTCTCAGCTGGGAGGTGACAGCGGCGGGAGCGGCGGGAGCGGGGGGA
GCACTAATCTGAGCGACATCATTGAGAAGGAGACTGGGAAACAGCTGGTCATTC
AGGAGTCCATCCTGATGCTGCCTGAGGAGGTGGAGGAAGTGATCGGCAACAAGC
CAGAGTCTGACATCCTGGTGCACACCGCCTACGACGAGTCCACAGATGAGAATG
TGATGCTGCTGACCTCTGACGCCCCCGAGTATAAGCCTTGGGCCCTGGTCATCCA
GGATTCTAACGGCGAGAATAAGATCAAGATGCTGAGCGGAGGATCCGGAGGATC
TGGAGGCAGCACCAACCTGTCTGACATCATCGAGAAGGAGACAGGCAAGCAGCT
GGTCATCCAGGAGAGCATCCTGATGCTGCCCGAAGAAGTCGAAGAAGTGATCGG
AAACAAGCCTGAGAGCGATATCCTGGTCCATACCGCCTACGACGAGAGTACCGA
CGAAAATGTGATGCTGCTGACATCCGACGCCCCAGAGTATAAGCCCTGGGCTCTG
GTCATCCAGGATTCCAACGGAGAGAACAAAATCAAAATGCTGTCTGGCGGCTCA
AAAAGAACCGCCGACGGCAGCGAATTCGAGCCCAAGAAGAAGAGGAAAGTC
```

ABEmax (SEQ ID NO: 48)

```
ATGAAACGGACAGCCGACGGAAGCGAGTTCGAGTCACCAAAGAAG
AAGCGGAAAGTCTCTGAAGTCGAGTTTAGCCACGAGTATTGGATGAGGCACGCA
CTGACCCTGGCAAAGCGAGCATGGGATGAAAGAGAAGTCCCCGTGGGCGCCGTG
CTGGTGCACAACAATAGAGTGATCGGAGAGGGATGGAACAGGCCAATCGGCCGC
CACGACCCTACCGCACACGCAGAGATCATGGCACTGAGGCAGGGAGGCCTGGTC
ATGCAGAATTACCGCCTGATCGATGCCACCCTGTATGTGACACTGGAGCCATGCG
TGATGTGCGCAGGAGCAATGATCCACAGCAGGATCGGAAGAGTGGTGTTCGGAG
CACGGGACGCCAAGACCGGCGCAGCAGGCTCCCTGATGGATGTGCTGCACCACC
CCGGCATGAACCACCGGGTGGAGATCACAGAGGGAATCCTGGCAGACGAGTGCG
CCGCCCTGCTGAGCGATTTCTTTAGAATGCGGAGACAGGAGATCAAGGCCCAGA
AGAAGGCACAGAGCTCCACCGACTCTGGAGGATCTAGCGGAGGATCCTCTGGAA
GCGAGACACCAGGCACAAGCGAGTCCGCCACACCAGAGAGCTCCGGCGGCTCCT
CCGGAGGATCCTCTGAGGTGGAGTTTTCCCACGAGTACTGGATGAGACATGCCCT
GACCCTGGCCAAGAGGGCACGCGATGAGAGGGAGGTGCCTGTGGGAGCCGTGCT
GGTGCTGAACAATAGAGTGATCGGCGAGGGCTGGAACAGAGCCATCGGCCTGCA
CGACCCAACAGCCCATGCCGAAATTATGGCCCTGAGACAGGGCGGCCTGGTCAT
GCAGAACTACAGACTGATTGACGCCACCCTGTACGTGACATTCGAGCCTTGCGTG
ATGTGCGCCGGCGCCATGATCCACTCTAGGATCGGCCGCGTGGTGTTTGGCGTGA
GGAACGCAAAAACCGGCGCCGCAGGCTCCCTGATGGACGTGCTGCACTACCCCG
GCATGAATCACCGCGTCGAAATTACCGAGGGAATCCTGGCAGATGAATGTGCCG
```

-continued

```
CCCTGCTGTGCTATTTCTTTCGGATGCCTAGACAGGTGTTCAATGCTCAGAAGAA
GGCCCAGAGCTCCACCGACTCCGGAGGATCTAGCGGAGGCTCCTCTGGCTCTGA
GACACCTGGCACAAGCGAGAGCGCAACACCTGAAAGCAGCGGGGGCAGCAGCG
GGGGGTCAGACAAGAAGTACAGCATCGGCCTGGCCATCGGCACCAACTCTGTGG
GCTGGGCCGTGATCACCGACGAGTACAAGGTGCCCAGCAAGAAATTCAAGGTGC
TGGGCAACACCGACCGGCACAGCATCAAGAAGAACCTGATCGGAGCCCTGCTGT
TCGACAGCGGCGAAACAGCCGAGGCCACCCGGCTGAAGAGAACCGCCAGAAGA
AGATACACCAGACGGAAGAACCGGATCTGCTATCTGCAAGAGATCTTCAGCAAC
GAGATGGCCAAGGTGGACGACAGCTTCTTCCACAGACTGGAAGAGTCCTTCCTG
GTGGAAGAGGATAAGAAGCACGAGCGGCACCCCATCTTCGGCAACATCGTGGAC
GAGGTGGCCTACCACGAGAAGTACCCCACCATCTACCACCTGAGAAAGAAACTG
GTGGACAGCACCGACAAGGCCGACCTGCGGCTGATCTATCTGGCCCTGGCCCAC
ATGATCAAGTTCCGGGGCCACTTCCTGATCGAGGGCGACCTGAACCCCGACAAC
AGCGACGTGGACAAGCTGTTCATCCAGCTGGTGCAGACCTACAACCAGCTGTTCG
AGGAAAACCCCATCAACGCCAGCGGCGTGGACGCCAAGGCCATCCTGTCTGCCA
GACTGAGCAAGAGCAGACGGCTGGAAAATCTGATCGCCCAGCTGCCCGGCGAGA
AGAAGAATGGCCTGTTCGGAAACCTGATTGCCCTGAGCCTGGGCCTGACCCCCA
ACTTCAAGAGCAACTTCGACCTGGCCGAGGATGCCAAACTGCAGCTGAGCAAGG
ACACCTACGACGACGACCTGGACAACCTGCTGGCCCAGATCGGCGACCAGTACG
CCGACCTGTTTCTGGCCGCCAAGAACCTGTCCGACGCCATCCTGCTGAGCGACAT
CCTGAGAGTGAACACCGAGATCACCAAGGCCCCCCTGAGCGCCTCTATGATCAA
GAGATACGACGAGCACCACCAGGACCTGACCCTGCTGAAAGCTCTCGTGCGGCA
GCAGCTGCCTGAGAAGTACAAAGAGATTTTCTTCGACCAGAGCAAGAACGGCTA
CGCCGGCTACATTGACGGCGGAGCCAGCCAGGAAGAGTTCTACAAGTTCATCAA
GCCCATCCTGGAAAAGATGGACGGCACCGAGGAACTGCTCGTGAAGCTGAACAG
AGAGGACCTGCTGCGGAAGCAGCGGACCTTCGACAACGGCAGCATCCCCCACCA
GATCCACCTGGGAGAGCTGCACGCCATTCTGCGGCGGCAGGAAGATTTTTACCCA
TTCCTGAAGGACAACCGGGAAAAGATCGAGAAGATCCTGACCTTCCGCATCCCC
TACTACGTGGGCCCTCTGGCCAGGGGAAACAGCAGATTCGCCTGGATGACCAGA
AAGAGCGAGGAAACCATCACCCCCTGGAACTTCGAGGAAGTGGTGGACAAGGGC
GCTTCCGCCCAGAGCTTCATCGAGCGGATGACCAACTTCGATAAGAACCTGCCCA
ACGAGAAGGTGCTGCCCAAGCACAGCCTGCTGTACGAGTACTTCACCGTGTATA
ACGAGCTGACCAAAGTGAAATACGTGACCGAGGGAATGAGAAAGCCCGCCTTCC
TGAGCGGCGAGCAGAAAAAGGCCATCGTGGACCTGCTGTTCAAGACCAACCGGA
AAGTGACCGTGAAGCAGCTGAAAGAGGACTACTTCAAGAAAATCGAGTGCTTCG
ACTCCGTGGAAATCTCCGGCGTGGAAGATCGGTTCAACGCCTCCCTGGGCACATA
CCACGATCTGCTGAAAATTATCAAGGACAAGGACTTCCTGGACAATGAGGAAAA
CGAGGACATTCTGGAAGATATCGTGCTGACCCTGACACTGTTTGAGGACAGAGA
GATGATCGAGGAACGGCTGAAAACCTATGCCCACCTGTTCGACGACAAAGTGAT
GAAGCAGCTGAAGCGGCGGAGATACACCGGCTGGGGCAGGCTGAGCCGGAAGC
TGATCAACGGCATCCGGGACAAGCAGTCCGGCAAGACAATCCTGGATTTCCTGA
```

-continued

AGTCCGACGGCTTCGCCAACAGAAACTTCATGCAGCTGATCCACGACGACAGCC

TGACCTTTAAAGAGGACATCCAGAAAGCCCAGGTGTCCGGCCAGGGCGATAGCC

TGCACGAGCACATTGCCAATCTGGCCGGCAGCCCCGCCATTAAGAAGGGCATCC

TGCAGACAGTGAAGGTGGTGGACGAGCTCGTGAAAGTGATGGGCCGGCACAAGC

CCGAGAACATCGTGATCGAAATGGCCAGAGAGAACCAGACCACCCAGAAGGGA

CAGAAGAACAGCCGCGAGAGAATGAAGCGGATCGAAGAGGGCATCAAAGAGCT

GGGCAGCCAGATCCTGAAAGAACACCCCGTGGAAAACACCCAGCTGCAGAACG

AGAAGCTGTACCTGTACTACCTGCAGAATGGGCGGGATATGTACGTGGACCAGG

AACTGGACATCAACCGGCTGTCCGACTACGATGTGGACCATATCGTGCCTCAGAG

CTTTCTGAAGGACGACTCCATCGACAACAAGGTGCTGACCAGAAGCGACAAGAA

CCGGGGCAAGAGCGACAACGTGCCCTCCGAAGAGGTCGTGAAGAAGATGAAGA

ACTACTGGCGGCAGCTGCTGAACGCCAAGCTGATTACCCAGAGAAAGTTCGACA

ATCTGACCAAGGCCGAGAGAGGCGGCCTGAGCGAACTGGATAAGGCCGGCTTCA

TCAAGAGACAGCTGGTGGAAACCCGGCAGATCACAAAGCACGTGGCACAGATCC

TGGACTCCCGGATGAACACTAAGTACGACGAGAATGACAAGCTGATCCGGGAAG

TGAAAGTGATCACCCTGAAGTCCAAGCTGGTGTCCGATTTCCGGAAGGATTTCCA

GTTTTACAAAGTGCGCGAGATCAACAACTACCACCACGCCCACGACGCCTACCT

GAACGCCGTCGTGGGAACCGCCCTGATCAAAAAGTACCCTAAGCTGGAAAGCGA

GTTCGTGTACGGCGACTACAAGGTGTACGACGTGCGGAAGATGATCGCCAAGAG

CGAGCAGGAAATCGGCAAGGCTACCGCCAAGTACTTCTTCTACAGCAACATCAT

GAACTTTTTCAAGACCGAGATTACCCTGGCCAACGGCGAGATCCGGAAGCGGCC

TCTGATCGAGACAAACGGCGAAACCGGGGAGATCGTGTGGGATAAGGGCCGGG

ATTTTGCCACCGTGCGGAAAGTGCTGAGCATGCCCCAAGTGAATATCGTGAAAA

AGACCGAGGTGCAGACAGGCGGCTTCAGCAAAGAGTCTATCCTGCCCAAGAGGA

ACAGCGATAAGCTGATCGCCAGAAAGAAGGACTGGGACCCTAAGAAGTACGGC

GGCTTCGACAGCCCCACCGTGGCCTATTCTGTGCTGGTGGTGGCCAAAGTGGAAA

AGGGCAAGTCCAAGAAACTGAAGAGTGTGAAAGAGCTGCTGGGGATCACCATCA

TGGAAAGAAGCAGCTTCGAGAAGAATCCCATCGACTTTCTGGAAGCCAAGGGCT

ACAAAGAAGTGAAAAAGGACCTGATCATCAAGCTGCCTAAGTACTCCCTGTTCG

AGCTGGAAAACGGCCGGAAGAGAATGCTGGCCTCTGCCGGCGAACTGCAGAAGG

GAAACGAACTGGCCCTGCCCTCCAAATATGTGAACTTCCTGTACCTGGCCAGCCA

CTATGAGAAGCTGAAGGGCTCCCCCGAGGATAATGAGCAGAAACAGCTGTTTGT

GGAACAGCACAAGCACTACCTGGACGAGATCATCGAGCAGATCAGCGAGTTCTC

CAAGAGAGTGATCCTGGCCGACGCTAATCTGGACAAAGTGCTGTCCGCCTACAA

CAAGCACCGGGATAAGCCCATCAGAGAGCAGGCCGAGAATATCATCCACCTGTT

TACCCTGACCAATCTGGGAGCCCCTGCCGCCTTCAAGTACTTTGACACCACCATC

GACCGGAAGAGGTACACCAGCACCAAAGAGGTGCTGGACGCCACCCTGATCCAC

CAGAGCATCACCGGCCTGTACGAGACACGGATCGACCTGTCTCAGCTGGGAGGT

GACTCTGGCGGCTCAAAAAAGAACCGCCGACGGCAGCGAATTCGAGCCCAAGAAG

AAGAGGAAAGTC

```
-continued
SCN9a RNA:
                                                  (SEQ ID NO: 49)
GUUAGUCCUUAAAAUGUAGGG MPDU1 RNA:
                                                  (SEQ ID NO: 50)
GUUCCCGGUCAUGCACUACAG HBG site 1 RNA:
                                                  (SEQ ID NO: 51)
CUUGACCAAUAGCCUUGACA HBG site 2 RNA:
                                                  (SEQ ID NO: 52)
AUAUUUGCAUUGAGAUAGUG
```

REFERENCES

1. Landrum, M. J. et al. ClinVar: public archive of interpretations of clinically relevant variants. Nucleic acids research 44, D862-868 (2016).
2. Komor, A. C., Kim, Y. B., Packer, M. S., Zuris, J. A. & Liu, D. R. Programmable editing of a target base in genomic DNA without double-stranded DNA cleavage. Nature 533, 420-+(2016).
3. Gaudelli, N. M. et al. Programmable base editing of A. T to G. C in genomic DNA without DNA cleavage. Nature 551, 464-+(2017).
4. Shimatani, Z. et al. Targeted base editing in rice and tomato using a CRISPR-Cas9 cytidine deaminase fusion. Nature biotechnology 35, 441-443 (2017).
5. Nishida, K. et al. Targeted nucleotide editing using hybrid prokaryotic and vertebrate adaptive immune systems. Science 353 (2016).
6. Komor, A. C. et al. Improved base excision repair inhibition and bacteriophage Mu Gam protein yields C:G-to-T:A base editors with higher efficiency and product purity. Sci Adv 3, eaao4774 (2017).
7. Komor, A. C., Badran, A. H. & Cell, L. D. R. CRISPR-based technologies for the manipulation of eukaryotic genomes. Cell (2017).
8. Satomura, A. et al. Precise genome-wide base editing by the CRISPR Nickase system in yeast. Sci Rep 7, 2095 (2017).
9. Zhang, Y. et al. Programmable base editing of zebrafish genome using a modified CRISPR-Cas9 system. Nat Commun 8, 118 (2017).
10. Lu, Y. M. & Zhu, J. K. Precise Editing of a Target Base in the Rice Genome Using a Modified CRISPR/Cas9 System. Molecular Plant 10, 523-525 (2017).
11. Zong, Y. et al. Precise base editing in rice, wheat and maize with a Cas9-cytidine deaminase fusion. Nature biotechnology 35, 438-440 (2017).
12. Billon, P. et al. CRISPR-Mediated Base Editing Enables Efficient Disruption of Eukaryotic Genes through Induction of STOP Codons. Molecular Cell 67, 1068-+(2017).
13. Kuscu, C. et al. CRISPR-STOP: gene silencing through base-editing-induced nonsense mutations. Nature methods 14, 710-712 (2017).
14. Kim, K. et al. Highly efficient RNA-guided base editing in mouse embryos. *Nature biotechnology* 35, 435-437 (2017).
15. Chadwick, A. C., Wang, X. & Musunuru, K. In Vivo Base Editing of PCSK9 (Proprotein Convertase Subtilisin/Kexin Type 9) as a Therapeutic Alternative to Genome Editing. Arterioscler Thromb Vasc Biol 37, 1741-1747 (2017).
16. Li, G. et al. Highly efficient and precise base editing in discarded human tripronuclear embryos. Protein Cell 8, 776-779 (2017).
17. Liang, P. et al. Correction of beta-thalassemia mutant by base editor in human embryos. Protein Cell 8, 811-822 (2017).
18. Ryu, S. M. et al. Adenine base editing in mouse embryos and an adult mouse model of Duchenne muscular dystrophy. Nature biotechnology (2017).
19. Kim, Y. B. et al. Increasing the genome-targeting scope and precision of base editing with engineered Cas9-cytidine deaminase fusions. Nature biotechnology 35, 371-376 (2017).
20. Hu, J. H. et al. Evolved Cas9 variants with broad PAM compatibility and high DNA specificity. Nature 556, 57-63 (2018).
21. Li, X. et al. Base editing with a Cpf1-cytidine deaminase fusion. Nature biotechnology 36, 324-327 (2018).
22. Rees, H. A. et al. Improving the DNA specificity and applicability of base editing through protein engineering and protein delivery. Nat Commun 8, 15790 (2017).
23. Kleinstiver, B. P., Pattanayak, V., Prew, M. S. & Nature, T. S. Q. High-fidelity CRISPR-Cas9 nucleases with no detectable genome-wide off-target effects. Nature (2016).
24. Chen, J. S. et al. Enhanced proofreading governs CRISPR-Cas9 targeting accuracy. Nature 550, 407-410 (2017).
25. Slaymaker, I. M. et al. Rationally engineered Cas9 nucleases with improved specificity. *Science* 351, 84-88 (2016).
26. Wang, T., Badran, A. H., Huang, T. P., Liu, D. R. Continuous directed evolution of proteins with improved soluble expression In Review. (2018).
27. Kim, J. H. et al. High cleavage efficiency of a 2A peptide derived from porcine teschovirus-1 in human cell lines, zebrafish and mice. PloS one 6, e18556 (2011).
28. Suzuki, K. et al. In vivo genome editing via CRISPR/Cas9 mediated homology-independent targeted integration. Nature 540, 144-149 (2016).
29. Hanson, G. & Coller, J. Codon optimality, bias and usage in translation and mRNA decay. Nature reviews. Molecular cell biology 19, 20-30 (2018).

30. Kim, S., Bae, T., Hwang, J. & Kim, J. S. Rescue of high-specificity Cas9 variants using sgRNAs with matched 5' nucleotides. Genome biology 18, 218 (2017).

31. Harms, M. J. & Thornton, J. W. Evolutionary biochemistry: revealing the historical and physical causes of protein properties. Nature reviews. Genetics 14, 559-571 (2013).

32. Wheeler, L. C., Lim, S. A., Marqusee, S. & Harms, M. J. The thermostability and specificity of ancient proteins. Curr Opin Struct Biol 38, 37-43 (2016).

33. Nguyen, V. et al. Evolutionary drivers of thermoadaptation in enzyme catalysis. Science 355, 289-294 (2017).

34. Wilson, C. et al. Kinase dynamics. Using ancient protein kinases to unravel a modern cancer drug's mechanism. Science 347, 882-886 (2015).

35. Risso, V. A., Gavira, J. A., Mejia-Carmona, D. F., Gaucher, E. A. & Sanchez-Ruiz, J. M. Hyperstability and substrate promiscuity in laboratory resurrections of Precambrian beta-lactamases. *J Am Chem Soc* 135, 2899-2902 (2013).

36. Williams, P. D., Pollock, D. D., Blackburne, B. P. & Goldstein, R. A. Assessing the accuracy of ancestral protein reconstruction methods. PLoS Comput Biol 2, e69 (2006).

37. Trudeau, D. L., Kaltenbach, M. & Tawfik, D. S. On the Potential Origins of the High Stability of Reconstructed Ancestral Proteins. Mol Biol Evol 33, 2633-2641 (2016).

38. Eick, G. N., Bridgham, J. T., Anderson, D. P., Harms, M. J. & Thornton, J. W. Robustness of reconstructed ancestral protein functions to statistical uncertainty. Molecular biology and evolution (2016).

39. Gumulya, Y. & Gillam, E. M. Exploring the past and the future of protein evolution with ancestral sequence reconstruction: the 'retro' approach to protein engineering. Biochem J 474, 1-19 (2017).

40. Megan F. Cole, V. E. C., Kelsey L. Gratton, and Eric A. Gaucher Reconstructing Evolutionary Adaptive Paths for Protein Engineering. Enyme Engineering Methods and Protocols 978 (2013).

41. Zakas, P. M. et al. Enhancing the pharmaceutical properties of protein drugs by ancestral sequence reconstruction. Nature biotechnology 35, 35-37 (2017).

42. Krokan, H. E., Drablos, F. & Slupphaug, G. Uracil in DNA—occurrence, consequences and repair. Oncogene 21, 8935-8948 (2002).

43. Schenk, B. et al. MPDU1 mutations underlie a novel human congenital disorder of glycosylation, designated type 1f. The Journal of clinical investigation 108, 1687-1695 (2001).

44. Bennett, D. L. & Woods, C. G. Painful and painless channelopathies. The Lancet. Neurology 13, 587-599 (2014).

45. Waxman, S. G. & Zamponi, G. W. Regulating excitability of peripheral afferents: emerging ion channel targets. Nature neuroscience 17, 153-163 (2014).

46. Traxler, E. A. et al. A genome-editing strategy to treat beta-hemoglobinopathies that recapitulates a mutation associated with a benign genetic condition. Nature medicine 22, 987-990 (2016).

47. Liu, N. et al. Direct Promoter Repression by BCL11A Controls the Fetal to Adult Hemoglobin Switch. Cell 173, 430-442 e417 (2018).

48. Amato, A. et al. Interpreting elevated fetal hemoglobin in pathology and health at the basic laboratory level: new and known gamma-gene mutations associated with hereditary persistence of fetal hemoglobin. International journal of laboratory hematology 36, 13-19 (2014).

49. Badran, A. H. et al. Continuous evolution of *Bacillus thuringiensis* toxins overcomes insect resistance. Nature 533, 58-63 (2016).

50. Gibson, D. G. et al. Enzymatic assembly of DNA molecules up to several hundred kilobases. Nature methods 6, 343-345 (2009).

51. Li, H. & Durbin, R. Fast and accurate short read alignment with Burrows-Wheeler transform. Bioinformatics 25, 1754-1760 (2009).

52. UniProt Consortium, T. UniProt: the universal protein knowledgebase. Nucleic acids research 46, 2699 (2018).

53. Altschul, S. F., Gish, W., Miller, W., Myers, E. W. & Lipman, D. J. Basic local alignment search tool. Journal of molecular biology 215, 403-410 (1990).

54. Katoh, K. & Standley, D. M. MAFFT multiple sequence alignment software version 7: improvements in performance and usability. Molecular biology and evolution 30, 772-780 (2013).

55. Kalyaanamoorthy, S., Minh, B. Q., Wong, T. K. F., von Haeseler, A. & Jermiin, L. S. ModelFinder: fast model selection for accurate phylogenetic estimates. Nature methods 14, 587-589 (2017).

56. Nguyen, L. T., Schmidt, H. A., von Haeseler, A. & Minh, B. Q. IQ-TREE: a fast and effective stochastic algorithm for estimating maximum-likelihood phylogenies. Mol Biol Evol 32, 268-274 (2015).

57. Hoang, D. T., Chernomor, O., von Haeseler, A., Minh, B. Q. & Vinh, L. S. UFBoot2: Improving the Ultrafast Bootstrap Approximation. Mol Biol Evol 35, 518-522 (2018).

58. Yang, Z. PAML 4: phylogenetic analysis by maximum likelihood. Molecular biology and evolution 24, 1586-1591 (2007).

Other Embodiments

The foregoing has been a description of certain non-limiting embodiments of the invention. Those of ordinary skill in the art will appreciate that various changes and modifications to this description may be made without departing from the spirit or scope of the present invention, as defined in the following claims.

EQUIVALENTS AND SCOPE

In the claims articles such as "a," "an," and "the" may mean one or more than one unless indicated to the contrary or otherwise evident from the context. Claims or descriptions that include "or" between one or more members of a group are considered satisfied if one, more than one, or all of the group members are present in, employed in, or otherwise relevant to a given product or process unless indicated to the contrary or otherwise evident from the context. The invention includes embodiments in which exactly one member of the group is present in, employed in, or otherwise relevant to a given product or process. The invention includes embodiments in which more than one, or all of the group members are present in, employed in, or otherwise relevant to a given product or process.

Furthermore, the invention encompasses all variations, combinations, and permutations in which one or more limitations, elements, clauses, and descriptive terms from one or more of the listed claims is introduced into another claim. For example, any claim that is dependent on another claim can be modified to include one or more limitations found in any other claim that is dependent on the same base claim. Where elements are presented as lists, e.g., in Markush group format, each subgroup of the elements is also disclosed, and any element(s) can be removed from the group. It should it be understood that, in general, where the invention, or aspects of the invention, is/are referred to as comprising particular elements and/or features, certain embodiments of the invention or aspects of the invention consist, or consist essentially of, such elements and/or features. For purposes of simplicity, those embodiments have not been specifically set forth in haec verba herein. It is also noted that the terms "comprising" and "containing" are intended to be open and permits the inclusion of additional elements or steps. Where ranges are given, endpoints are included. Furthermore, unless otherwise indicated or otherwise evident from the context and understanding of one of ordinary skill in the art, values that are expressed as ranges can assume any specific value or sub-range within the stated ranges in different embodiments of the invention, to the tenth of the unit of the lower limit of the range, unless the context clearly dictates otherwise.

This application refers to various issued patents, published patent applications, journal articles, and other publications, all of which are incorporated herein by reference. If there is a conflict between any of the incorporated references and the instant specification, the specification shall control. In addition, any particular embodiment of the present invention that falls within the prior art may be explicitly excluded from any one or more of the claims. Because such embodiments are deemed to be known to one of ordinary skill in the art, they may be excluded even if the exclusion is not set forth explicitly herein. Any particular embodiment of the invention can be excluded from any claim, for any reason, whether or not related to the existence of prior art.

Those skilled in the art will recognize or be able to ascertain using no more than routine experimentation many equivalents to the specific embodiments described herein. The scope of the present embodiments described herein is not intended to be limited to the above Description, but rather is as set forth in the appended claims. Those of ordinary skill in the art will appreciate that various changes and modifications to this description may be made without departing from the spirit or scope of the present invention, as defined in the following claims.

---

SEQUENCE LISTING (694 sequences)

SEQ ID NO: 1 - protein, 18 aa, Artificial Sequence
  Synthetic
KRTADGSEFESPKKKRKV

SEQ ID NO: 2 - protein, 17 aa, Artificial Sequence
  Synthetic
KRTADGSEFEPKKKRKV

SEQ ID NO: 3 - protein, 1367 aa, Artificial Sequence
  Synthetic
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 4 - protein, 228 aa, Artificial Sequence
  Synthetic
SSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLK

SEQ ID NO: 5 - protein, 228 aa, Artificial Sequence
  Synthetic
SSETGPVAVDPTLRRRIEPHEFEVFFDPRELRKETCLLYEIKWGTSHKIWRHSSKNTTKHVEVNFIEKFTSERHFCPSTSCSITWFLSWSPCGECSKAITEFLSQHPNVTLVIYVARLYHHMDQQNRQGLRDLVNSGVTIQIMTAPEYDYCWRNFVNYPPGKEAHWPRYPPLWMKLYALELHAGILGLPPCLNILRRKQPQLTFFTIALQSCHYQRLPPHILWATGLK

SEQ ID NO: 6 - protein, 228 aa, Artificial Sequence
  Synthetic
SSETGPVAVDPTLRRRIEPHEFEVFFDPRELRKEACLLYEIKWGTSHKIWRNSGKNTTKHVEVNFIEKFTSERHFCPSISCSITWFLSWSPCWECSKAIREFLSQHPNVTLVIYVARLFQHMDQQNRQGLRDLVNSGVTIQIMTASEYDHCWRNFVNYPPGKEAHWPRYPPLWMKLYALELHAGILGLPPCLNILRRKQPQLTFFTIALQSCHYQRLPPHILWATGLK

SEQ ID NO: 7 - protein, 228 aa, Artificial Sequence
  Synthetic
SSETGPVAVDPTLRRRIEPEFFNRNYDPRELRKETYLLYEIKWGKESKIWRHTSNNRTQHAEVNFLENFFNELYFNPSTHCSITWFLSWSPCGECSKAIVEFLKEHPNVNLEIYVARLYLCEDERNRQGLRDLVNSGVTIRIMNLPDYNYCWRTFVSHQGGDEDYWPRHFAPWVRLYVLELYCIILGLPPCLNILRRKQPQLTFFTIALQSCHYQRLPPHILWATGLK

SEQ ID NO: 8 - protein, 228 aa, Artificial Sequence
  Synthetic
SSETGPVAVDPTLRRRIEPFYFQFNNDPRACRRKTYLCYELKQDGSTWVWKRTLHNKGRHAEICFLEKISSLEKLDPAQHYRITWYMSWSPCSNCAQKIVDFLKEHPHVNLRIYVARLYYHEEERYQEGLRNLRRSGVSIRVMDLPDFEHCWETFVDNGGGPFQPWPGLEELNSKQLSRRLQAGILGLPPCLNILRRKQPQLTFFTIALQSCHYQRLPPHILWATGLK

SEQ ID NO: 9 - protein, 228 aa, Artificial Sequence
  Synthetic
SSETGPVAVDPTLRRRIEPFHFQFNNDPRAYRRKTYLCYELKQDGSTWVLDRTLRNKGRHAEICFLDKINSWERLDPAQHYRVTWYMSWSPCSNCAQQVVDFLKEHPHVNLRIFAARLYYHEQRRYQEGLRSLRGSGVPVAVMTLPDFEHCWETFVDHGGRPFQPWDGLEELNSRSLSRRLQAGILGLPPCLNILRRKQPQLTFFTIALQSCHYQRLPPHILWATGLK

SEQ ID NO: 10 - protein, 84 aa, Artificial Sequence
  Synthetic
MTNLSDIIEKETGKQLVIQESILMLPEEVEEVIGNKPESDILVHTAYDESTDENVMLLTSDAPEYKPWALVIQDSNGENKIKML

SEQ ID NO: 11 - protein, 32 aa, Artificial Sequence
  Synthetic
SGGSSGGSSGSETPGTSESATPESSGGSSGGS

SEQ ID NO: 12 - protein, 1853 aa, Artificial Sequence
  Synthetic
MKRTADGSEFESPKKKRKVSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSGGSGGSTNLSDIIEKETGKQLVIQESILMLPEEVEEVIGNKPESDILVHTAYDESTDENVMLLTSDAPEYKPWALVIQDSNGENKIKMLSGGSGGSGGSTNLSDIIEKETGKQLVIQESILMLPEEVEEVIGNKPESDILVHTAYDESTDENVMLLTSDAPEYKPWALVIQDSNGENKIKMLSGGSKRTADGSEFEPKKKRKV

SEQ ID NO: 13 - protein, 1853 aa, Artificial Sequence
  Synthetic
MKRTADGSEFESPKKKRKVSSETGPVAVDPTLRRRIEPHEFEVFFDPRELRKETCLLYEIKWGTSHKIWRHSSKNTTKHVEVNFIEKFTSERHFCPSTSCSITWFLSWSPCGECSKAITEFLSQHPNVTLVIYVARLYHHMDQQNRQGLRDLVNSGVTIQIMTAPEYDYCWRNFVNYPPGKEAHWPRYPPLWMKLYALELHAGILGLPPCLNILRRKQPQLTFFTIALQSCHYQRLPPHILWATGLKSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSGGSGGSTNLSDIIEKETGKQLVIQESILMLPEEVEEVIGNKPESDILVHTAYDESTDENVMLLTSDAPEYKPWALVIQDSNGENKIKMLSGGSGGSGGSTNLSDIIEKETGKQLVIQESILMLPEEVEEVIGNKPESDILVHTAYDESTDENVMLLTSDAPEYKPWALVIQDSNGENKIKMLSGGSKRTADGSEFEPKKKRKV

SEQ ID NO: 14 - protein, 1853 aa, Artificial Sequence
  Synthetic
MKRTADGSEFESPKKKRKVSSETGPVAVDPTLRRRIEPHEFEVFFDPRELRKEACLLYEIKWGTSHKIWRNSGKNTTKHVEVNFIEKFTSERHFCPSISCSITWFLSWSPCWECSKAIREFLSQHPNVTLVIYVARLFQHMDQQNRQGLRDLVNSGVTIQIMTASEYDHCWRNFVNYPPGKEAHWPRYPPLWMKLYALELHAGILGLPPCLNILRRKQPQLTFFTIALQSCHYQRLPPHILWATGLKSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSGGSGGSTNLSDIIEKETGKQLVIQESILMLPEEVEEVIGNKPESDILVHTAYDESTDENVMLLTSDAPEYKPWALVIQDSNGENKIKMLSGGSGGSGGSTNLSDIIEKETGKQLVIQESILMLPEEVEEVIGNKPESDILVHTAYDESTDENVMLLTSDAPEYKPWALVIQDSNGENKIKMLSGGSKRTADGSEFEPKKKRKV

SEQ ID NO: 15 - protein, 167 aa, Artificial Sequence
  Synthetic
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTD

SEQ ID NO: 16 - protein, 160 aa, Staphylococcus aureus
MGSHMTNDIYFMTLAIEEAKKAAQLGEVPIGAIITKDDEVIARAHNLRETLQQPTAHAEHIAIERAAKVLGSWRLEGCTLYVTLEPCVMCAGTIVMSRIPRVVYGADDPKGGCSGSLMNLLQQSNFNHRAIVDKGVLKEACSTLLTTFFKNLRANKKSTN

SEQ ID NO: 17 - protein, 161 aa, Bacillus subtilis
MTQDELYMKEAIKEAKKAEEKGEVPIGAVLVINGEIIARAHNLRETEQRSIAHAEMLVIDEACKALGTWRLEGATLYVTLEPCPMCAGAVVLSRVEKVVFGAFDPKGGCSGTLMNLLQEERFNHQAEVVSGVLEEECGGMLSAFFRELRKKKKAARKNLSE

SEQ ID NO: 18 - protein, 183 aa, Salmonella typhimurium
MPPAFITGVTSLSDVELDHEYWMRHALTLAKRAWDEREVPVGAVLVHNHRVIGEGWNRPIGRHDPTAHAEIMALRQGGLVLQNYRLLDTTLYVTLEPCVMCAGAMVHSRIGRVVFGARDAKTGAAGSLIDVLHHPGMNHRVEIIEGVLRDECATLLSDFFRMRRQEIKALKKADRAEGAGPAV

SEQ ID NO: 19 - protein, 164 aa, Shewanella putrefaciens
MDEYWMQVAMQMAEKAEAAGEVPVGAVLVKDGQQIATGYNLSISQHDPTAHAEILCLRSAGKKLENYRLLDATLYITLEPCAMCAGAMVHSRIARVVYGARDEKTGAAGTVVNLLQHPAFNHQVEVTSGVLAEACSAQLSRFFKRRRDEKKALKLAQRAQQGIE

SEQ ID NO: 20 - protein, 173 aa, Haemophilus influenzae
MDAAKVRSEFDEKMMRYALELADKAEALGEIPVGAVLVDDARNIIGEGWNLSIVQSDPTAHAEIIALRNGAKNIQNYRLLNSTLYVTLEPCTMCAGAILHSRIKRLVFGASDYKTGAIGSRFHFFDDYKMNHTLEITSGVLAEECSQKLSTFFQKRREEKKIEKALLKSLSDK

SEQ ID NO: 21 - protein, 161 aa, Caulobacter crescentus
MRTDESEDQDHRMMRLALDAARAAAEAGETPVGAVILDPSTGEVIATAGNGPIAAHDPTAHAEIAAMRAAAAKLGNYRLTDLTLVVTLEPCAMCAGAISHARIGRVVFGADDPKGGAVVHGPKFFAQPTCHWRPEVTGGVLADESADLLRGFFRARRKAKI

SEQ ID NO: 22 - protein, 179 aa, Geobacter sulfurreducens
MSSLKKTPIRDDAYWMGKAIREAAKAAARDEVPIGAVIVRDGAVIGRGHNLREGSNDPSAHAEMIAIRQAARRSANWRLTGATLYVTLEPCLMCMGAIILARLERVVFGCYDPKGGAAGSLYDLSADPRLNHQVRLSPGVCQEECGTMLSDFFRDLRRRKKAKATPALFIDERKVPPEP

SEQ ID NO: 23 - protein, 166 aa, Artificial Sequence
  Synthetic
SEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTD

SEQ ID NO: 24 - protein, 1800 aa, Artificial Sequence
  Synthetic
MKRTADGSEFESPKKKRKVMSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDKRTADGSEFEPKKKRKV

SEQ ID NO: 25 - protein, 10 aa, Artificial Sequence
  Synthetic
SGGSGGSGGS

SEQ ID NO: 26 - protein, 4 aa, Artificial Sequence
  Synthetic
SGGS

SEQ ID NO: 27 - DNA, 54 bp, Artificial Sequence
  Synthetic
aaacggacagccgacggaagcgagttcgagtcaccaaagaagaagcggaaagtc

SEQ ID NO: 28 - DNA, 51 bp, Artificial Sequence
  Synthetic
aaaagaaccgccgacggcagcgaattcgagcccaagaagaagaggaaagtc

SEQ ID NO: 29 - DNA, 4101 bp, Artificial Sequence
  Synthetic
gacaagaagtacagcatcggcctggacatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgac

SEQ ID NO: 30 - DNA, 4101 bp, Artificial Sequence
  Synthetic
gacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgac

SEQ ID NO: 31 - DNA, 96 bp, Artificial Sequence
  Synthetic
tctggaggatctagcggaggatcctctggcagcgagacaccaggaacaagcgagtcagcaacaccagagagcagtggcggcagcagcggcggcagc

SEQ ID NO: 32 - DNA, 96 bp, Artificial Sequence
  Synthetic
tctggaggatctagcggaggatcctctggaagcgagacaccaggcacaagcgagtccgccacaccagagagctccggcggctcctccggaggatcc

SEQ ID NO: 33 - DNA, 96 bp, Artificial Sequence
  Synthetic
tccggaggatctagcggaggctcctctggctctgagacacctggcacaagcgagagcgcaacacctgaaagcagcgggggcagcagcggggggtca

SEQ ID NO: 34 - DNA, 30 bp, Artificial Sequence
  Synthetic
agcggcgggagcggcgggagcggggggagc

SEQ ID NO: 35 - DNA, 30 bp, Artificial Sequence
  Synthetic
agcggaggatccggaggatctggaggcagc

SEQ ID NO: 36 - DNA, 12 bp, Artificial Sequence
  Synthetic
tctggcggctca

SEQ ID NO: 37 - DNA, 684 bp, Rattus rattus
tcctcagagactgggcctgtcgccgtcgatccaaccctgcgccgccggattgaacctcacgagtttgaagtgttctttgacccccgggagctgagaaaggagacatgcctgctgtacgagatcaactggggaggcaggcactccatctggaggcacacctctcagaacacaaataagcacgtggaggtgaacttcatcgagaagtttaccacagagcggtacttctgccccaataccagatgtagcatcacatggtttctgagctggtccccttgcggagagtgtagcagggccatcaccgagttcctgtccagatatccacacgtgacactgtttatctacatcgccaggctgtatcaccacgcagacccaaggaataggcagggcctgcgcgatctgatcagctccggcgtgaccatccagatcatgacagagcaggagtccggctactgctggcggaacttcgtgaattattctcctagcaacgaggcccactggcctaggtacccacacctgtgggtgcgcctgtacgtgctggagctgtattgcatcatcctgggcctgcccccttgtctgaatatcctgcggagaaagcagccccagctgaccttctttacaatcgccctgcagtcttgtcactatcagaggctgccaccccacatcctgtgggccacaggcctgaag

SEQ ID NO: 38 - DNA, 684 bp, Artificial Sequence
  Synthetic
agcagtgaaaccggaccagtggcagtggacccaaccctgaggagacggattgagccccatgaatttgaagtgttctttgacccaagggagctgaggaaggagacatgcctgctgtacgagatcaagtggggcacaagccacaagatctggcgccacagctccaagaacaccacaaagcacgtggaagtgaatttcatcgagaagtttacctccgagcggcacttctgcccctctaccagctgttccatcacatggtttctgtcttggagcccttgcggcgagtgttccaaggccatcaccgagttcctgtctcagcaccctaacgtgaccctggtcatctacgtggcccggctgtatcaccacatggaccagcagaacaggcagggcctgcgcgatctggtgaattctggcgtgaccatccagatcatgacagccccagagtacgactattgctggcggaacttcgtgaattatccacctggcaaggaggcacactggccaagatacccacccctgtggatgaagctgtatgcactggagctgcacgcaggaatcctgggcctgcctccatgtctgaatatcctgcggagaaagcagccccagctgacatttttcaccattgctctgcagtcttgtcactatcagcggctgcctcctcatattctgtgggctacaggccttaaa

SEQ ID NO: 39 - DNA, 684 bp, Artificial Sequence
  Synthetic
tcatcagaaacaggaccagtcgccgtggacccaacactgaggagaaggattgagccccatgaatttgaagtctttttcgaccccagggagctgaggaaggaggcatgcctgctgtacgagatcaagtggggcacaagccacaagatctggcgcaacagcggcaagaacaccacaaagcacgtggaagtgaatttcatcgagaagtttacctccgagcggcacttctgcccctctatcagctgttccatcacatggtttctgtcttggagcccttgctgggagtgttccaaggccatccgcgagttcctgtctcagcaccctaacgtgaccctggtcatctacgtggcccggctgtttcaacacatggaccagcagaacaggcagggcctgcgcgatctggtgaattctggcgtgaccatccagatcatgacagcctcagagtacgaccattgctggcggaacttcgtgaattatccacctggcaaggaggcacactggccaagatacccacccctgtggatgaagctgtatgcactggagctgcacgcaggaatcctgggcctgcctccatgtctgaatatcctgcggagaaagcagccccagctgacatttttcactatcgcactgcagagctgtcattaccagagactgcctcctcatatcctgtgggctacaggccttaaa

SEQ ID NO: 40 - DNA, 684 bp, Artificial Sequence
  Synthetic
agcagcgagacaggacccgtggcagtggaccctacactgaggaggaggattgagcccgaatttttcaacaggaactacgaccccagagagctgcggaaggagacatacctgctgtatgagatcaagtggggcaaggagtccaagatctggcggcacacctctaacaatagaacacagcacgccgaggtgaacttcctggagaacttctttaatgagctgtactttaatccttctacccactgcagcatcacatggttcctgagctggtccccatgcggcgagtgttctaaggccatcgtggagtttctgaaggagcaccccaacgtgaatctggagatctacgtggccaggctgtatctgtgcgaggacgagaggaacaggcagggcctgcgggatctggtgaatagcggcgtgaccatcagaatcatgaacctgcctgactacaattattgttggcgcacattcgtgtcccaccagggaggcgacgaggattattggccaaggcactttgcaccatgggtgcgcctgtacgtgctggagctgtattgcatcatcctgggcctgcccccttgtctgaacatcctgcggagaaagcagccccagctgacattcttcaccatcgcactgcagagttgtcattaccagcgactgcctcctcatatcctgtgggctacaggccttaaa

SEQ ID NO: 41 - DNA, 684 bp, Artificial Sequence
  Synthetic
tcatcagagaccggacctgtggcagtggacccaaccctgcgacggagaatcgagcccttttactttcagttcaacaacgacccaagagcctgccggagaaagacctacctgtgctatgagctgaagcaggacggctctacctgggtgtggaagcggacactgcacaacaagggcagacacgccgagatctgcttcctggagaagatcagctccctggagaagctggaccctgcccagcactacaggatcacatggtatatgtcttggagcccatgctccaactgtgcccagaagatcgtggattttctgaaggagcacccacacgtgaatctgcggatctacgtggccagactgtactatcacgaggaggagaggtatcaggagggcctgaggaacctgaggcgctccggcgtgtctatcagagtgatggacctgcccgatttcgagcactgctgggagacattcgtggataacggaggaggacctttccagccatggcccggcctggaggagctgaatagcaagcagctgtcccggagactgcaggcaggaatcctgggcctgcccccttgtctgaatatcctgaggcgcaagcagccccagctgacatttttcaccatcgcactgcagagttgtcattatcagcgactgcctcctcatatcctgtgggctacaggccttaaa

SEQ ID NO: 42 - DNA, 684 bp, Artificial Sequence
  Synthetic
agcagcgagaccggacctgtggcagtggacccaaccctgagaagacgcattgagccatttcattttcagtttaacaacgaccccagagcctaccggagaaagacctacctgtgctatgagctgaagcaggacggctccacctgggtgctggatcggacactgagaaacaagggccggcacgccgagatctgtttcctggacaagatcaattcctgggagaggctggatcccgcccagcactaccgcgtgacatggtatatgagctggtccccttgctctaactgtgcccagcaggtggtggatttcctgaaggagcacccacacgtgaatctgcggatctttgccgccagactgtactatcacgagcagaggcgctatcaggagggcctgcggagcctgaggggaagcggagtgcctgtggccgtgatgaccctgccagacttcgagcactgctgggagacatttgtggatcacggcggccggccattccagccatgggacggcctggaggagctgaactctaggagcctgtcccggagactgcaggcaggaatcctgggcctgcccccttgtctgaatatcctgaggcgcaagcagccccagctgaccttttttaccatcgcactgcagagttgtcactaccagagactgcctcctcatatcctgtgggctacaggccttaaa

SEQ ID NO: 43 - DNA, 498 bp, Artificial Sequence
  Synthetic
tctgaagtcgagtttagccacgagtattggatgaggcacgcactgaccctggcaaagcgagcatgggatgaaagagaagtccccgtgggcgccgtgctggtgcacaacaatagagtgatcggagagggatggaacaggccaatcggccgccacgaccctaccgcacacgcagagatcatggcactgaggcagggaggcctggtcatgcagaattaccgcctgatcgatgccaccctgtatgtgacactggagccatgcgtgatgtgcgcaggagcaatgatccacagcaggatcggaagagtggtgttcggagcacgggacgccaagaccggcgcagcaggctccctgatggatgtgctgcaccaccccggcatgaaccaccgggtggagatcacagagggaatcctggcagacgagtgcgccgccctgctgagcgatttctttagaatgcggagacaggagatcaaggcccagaagaaggcacagagctccaccgac

SEQ ID NO: 44 - DNA, 498 bp, Artificial Sequence
  Synthetic
tctgaggtggagttttcccacgagtactggatgagacatgccctgaccctggccaagagggcacgcgatgagagggaggtgcctgtgggagccgtgctggtgctgaacaatagagtgatcggcgagggctggaacagagccatcggcctgcacgacccaacagcccatgccgaaattatggccctgagacagggcggcctggtcatgcagaactacagactgattgacgccaccctgtacgtgacattcgagccttgcgtgatgtgcgccggcgccatgatccactctaggatcggccgcgtggtgtttggcgtgaggaacgcaaaaaccggcgccgcaggctccctgatggacgtgctgcactaccccggcatgaatcaccgcgtcgaaattaccgagggaatcctggcagatgaatgtgccgccctgctgtgctatttctttcggatgcctagacaggtgttcaatgctcagaagaaggcccagagctccaccgac

SEQ ID NO: 45 - DNA, 5559 bp, Artificial Sequence
  Synthetic
atgaaacggacagccgacggaagcgagttcgagtcaccaaagaagaagcggaaagtctcctcagagactgggcctgtcgccgtcgatccaaccctgcgccgccggattgaacctcacgagtttgaagtgttctttgacccccgggagctgagaaaggagacatgcctgctgtacgagatcaactggggaggcaggcactccatctggaggcacacctctcagaacacaaataagcacgtggaggtgaacttcatcgagaagtttaccacagagcggtacttctgccccaataccagatgtagcatcacatggtttctgagctggtccccttgcggagagtgtagcagggccatcaccgagttcctgtccagatatccacacgtgacactgtttatctacatcgccaggctgtatcaccacgcagacccaaggaataggcagggcctgcgcgatctgatcagctccggcgtgaccatccagatcatgacagagcaggagtccggctactgctggcggaacttcgtgaattattctcctagcaacgaggcccactggcctaggtacccacacctgtgggtgcgcctgtacgtgctggagctgtattgcatcatcctgggcctgcccccttgtctgaatatcctgcggagaaagcagccccagctgaccttctttacaatcgccctgcagtcttgtcactatcagaggctgccaccccacatcctgtgggccacaggcctgaagtctggaggatctagcggaggatcctctggcagcgagacaccaggaacaagcgagtcagcaacaccagagagcagtggcggcagcagcggcggcagcgacaagaagtacagcatcggcctggacatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgacagcggcgggagcggcgggagcggggggagcactaatctgagcgacatcattgagaaggagactgggaaacagctggtcattcaggagtccatcctgatgctgcctgaggaggtggaggaagtgatcggcaacaagccagagtctgacatcctggtgcacaccgcctacgacgagtccacagatgagaatgtgatgctgctgacctctgacgcccccgagtataagccttgggccctggtcatccaggattctaacggcgagaataagatcaagatgctgagcggaggatccggaggatctggaggcagcaccaacctgtctgacatcatcgagaaggagacaggcaagcagctggtcatccaggagagcatcctgatgctgcccgaagaagtcgaagaagtgatcggaaacaagcctgagagcgatatcctggtccataccgcctacgacgagagtaccgacgaaaatgtgatgctgctgacatccgacgccccagagtataagccctgggctctggtcatccaggattccaacggagagaacaaaatcaaaatgctgtctggcggctcaaaaagaaccgccgacggcagcgaattcgagcccaagaagaagaggaaagtc

SEQ ID NO: 46 - DNA, 5559 bp, Artificial Sequence
  Synthetic
atgaaacggacagccgacggaagcgagttcgagtcaccaaagaagaagcggaaagtcagcagtgaaaccggaccagtggcagtggacccaaccctgaggagacggattgagccccatgaatttgaagtgttctttgacccaagggagctgaggaaggagacatgcctgctgtacgagatcaagtggggcacaagccacaagatctggcgccacagctccaagaacaccacaaagcacgtggaagtgaatttcatcgagaagtttacctccgagcggcacttctgcccctctaccagctgttccatcacatggtttctgtcttggagcccttgcggcgagtgttccaaggccatcaccgagttcctgtctcagcaccctaacgtgaccctggtcatctacgtggcccggctgtatcaccacatggaccagcagaacaggcagggcctgcgcgatctggtgaattctggcgtgaccatccagatcatgacagccccagagtacgactattgctggcggaacttcgtgaattatccacctggcaaggaggcacactggccaagatacccacccctgtggatgaagctgtatgcactggagctgcacgcaggaatcctgggcctgcctccatgtctgaatatcctgcggagaaagcagccccagctgacatttttcaccattgctctgcagtcttgtcactatcagcggctgcctcctcatattctgtgggctacaggccttaaatctggaggatctagcggaggatcctctggcagcgagacaccaggaacaagcgagtcagcaacaccagagagcagtggcggcagcagcggcggcagcgacaagaagtacagcatcggcctggacatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgacagcggcgggagcggcgggagcggggggagcactaatctgagcgacatcattgagaaggagactgggaaacagctggtcattcaggagtccatcctgatgctgcctgaggaggtggaggaagtgatcggcaacaagccagagtctgacatcctggtgcacaccgcctacgacgagtccacagatgagaatgtgatgctgctgacctctgacgcccccgagtataagccttgggccctggtcatccaggattctaacggcgagaataagatcaagatgctgagcggaggatccggaggatctggaggcagcaccaacctgtctgacatcatcgagaaggagacaggcaagcagctggtcatccaggagagcatcctgatgctgcccgaagaagtcgaagaagtgatcggaaacaagcctgagagcgatatcctggtccataccgcctacgacgagagtaccgacgaaaatgtgatgctgctgacatccgacgccccagagtataagccctgggctctggtcatccaggattccaacggagagaacaaaatcaaaatgctgtctggcggctcaaaaagaaccgccgacggcagcgaattcgagcccaagaagaagaggaaagtc

SEQ ID NO: 47 - DNA, 5559 bp, Artificial Sequence
  Synthetic
atgaaacggacagccgacggaagcgagttcgagtcaccaaagaagaagcggaaagtctcatcagaaacaggaccagtcgccgtggacccaacactgaggagaaggattgagccccatgaatttgaagtctttttcgaccccagggagctgaggaaggaggcatgcctgctgtacgagatcaagtggggcacaagccacaagatctggcgcaacagcggcaagaacaccacaaagcacgtggaagtgaatttcatcgagaagtttacctccgagcggcacttctgcccctctatcagctgttccatcacatggtttctgtcttggagcccttgctgggagtgttccaaggccatccgcgagttcctgtctcagcaccctaacgtgaccctggtcatctacgtggcccggctgtttcaacacatggaccagcagaacaggcagggcctgcgcgatctggtgaattctggcgtgaccatccagatcatgacagcctcagagtacgaccattgctggcggaacttcgtgaattatccacctggcaaggaggcacactggccaagatacccacccctgtggatgaagctgtatgcactggagctgcacgcaggaatcctgggcctgcctccatgtctgaatatcctgcggagaaagcagccccagctgacatttttcactatcgcactgcagagctgtcattaccagagactgcctcctcatatcctgtgggctacaggccttaaatctggaggatctagcggaggatcctctggcagcgagacaccaggaacaagcgagtcagcaacaccagagagcagtggcggcagcagcggcggcagcgacaagaagtacagcatcggcctggacatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgacagcggcgggagcggcgggagcggggggagcactaatctgagcgacatcattgagaaggagactgggaaacagctggtcattcaggagtccatcctgatgctgcctgaggaggtggaggaagtgatcggcaacaagccagagtctgacatcctggtgcacaccgcctacgacgagtccacagatgagaatgtgatgctgctgacctctgacgcccccgagtataagccttgggccctggtcatccaggattctaacggcgagaataagatcaagatgctgagcggaggatccggaggatctggaggcagcaccaacctgtctgacatcatcgagaaggagacaggcaagcagctggtcatccaggagagcatcctgatgctgcccgaagaagtcgaagaagtgatcggaaacaagcctgagagcgatatcctggtccataccgcctacgacgagagtaccgacgaaaatgtgatgctgctgacatccgacgccccagagtataagccctgggctctggtcatccaggattccaacggagagaacaaaatcaaaatgctgtctggcggctcaaaaagaaccgccgacggcagcgaattcgagcccaagaagaagaggaaagtc

SEQ ID NO: 48 - DNA, 5409 bp, Artificial Sequence
  Synthetic
atgaaacggacagccgacggaagcgagttcgagtcaccaaagaagaagcggaaagtctctgaagtcgagtttagccacgagtattggatgaggcacgcactgaccctggcaaagcgagcatgggatgaaagagaagtccccgtgggcgccgtgctggtgcacaacaatagagtgatcggagagggatggaacaggccaatcggccgccacgaccctaccgcacacgcagagatcatggcactgaggcagggaggcctggtcatgcagaattaccgcctgatcgatgccaccctgtatgtgacactggagccatgcgtgatgtgcgcaggagcaatgatccacagcaggatcggaagagtggtgttcggagcacgggacgccaagaccggcgcagcaggctccctgatggatgtgctgcaccaccccggcatgaaccaccgggtggagatcacagagggaatcctggcagacgagtgcgccgccctgctgagcgatttctttagaatgcggagacaggagatcaaggcccagaagaaggcacagagctccaccgactctggaggatctagcggaggatcctctggaagcgagacaccaggcacaagcgagtccgccacaccagagagctccggcggctcctccggaggatcctctgaggtggagttttcccacgagtactggatgagacatgccctgaccctggccaagagggcacgcgatgagagggaggtgcctgtgggagccgtgctggtgctgaacaatagagtgatcggcgagggctggaacagagccatcggcctgcacgacccaacagcccatgccgaaattatggccctgagacagggcggcctggtcatgcagaactacagactgattgacgccaccctgtacgtgacattcgagccttgcgtgatgtgcgccggcgccatgatccactctaggatcggccgcgtggtgtttggcgtgaggaacgcaaaaaccggcgccgcaggctccctgatggacgtgctgcactaccccggcatgaatcaccgcgtcgaaattaccgagggaatcctggcagatgaatgtgccgccctgctgtgctatttctttcggatgcctagacaggtgttcaatgctcagaagaaggcccagagctccaccgactccggaggatctagcggaggctcctctggctctgagacacctggcacaagcgagagcgcaacacctgaaagcagcgggggcagcagcggggggtcagacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgactctggcggctcaaaaagaaccgccgacggcagcgaattcgagcccaagaagaagaggaaagtc

SEQ ID NO: 49 - RNA, 21 nt, Artificial Sequence
  Synthetic
guuaguccuuaaaauguaggg

SEQ ID NO: 50 - RNA, 21 nt, Artificial Sequence
  Synthetic
guucccggucaugcacuacag

SEQ ID NO: 51 - RNA, 20 nt, Artificial Sequence
  Synthetic
cuugaccaauagccuugaca

SEQ ID NO: 52 - RNA, 20 nt, Artificial Sequence
  Synthetic
auauuugcauugagauagug

SEQ ID NO: 53 - protein, 1367 aa, Artificial Sequence
  Synthetic
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 54 - protein, 1367 aa, Artificial Sequence; identical to SEQ ID NO: 3
  Synthetic

SEQ ID NO: 55 - protein, 1367 aa, Artificial Sequence
  Synthetic
DKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 56 - protein, 345 aa, Sulfolobus islandicus
MEVPLYNIFGDNYIIQVATEAENSTIYNNKVEIDDEELRNVLNLAYKIAKNNEDAAAERRGKAKKKKGEEGETTTSNIILPLSGNDKNPWTETLKCYNFPTTVALSEVFKNFSQVKECEEVSAPSFVKPEFYEFGRSPGMVERTRRVKLEVEPHYLIIAAAGWVLTRLGKAKVSEGDYVGVNVFTPTRGILYSLIQNVNGIVPGIKPETAFGLWIARKVVSSVTNPNVSVVRIYTISDAVGQNPTTINGGFSIDLTKLLEKRYLLSERLEAIARNALSISSNMRERYIVLANYIYEYLTGSKRLEDLLYFANRDLIMNLNSDDGKVRDLKLISAYVNGELIRGEG

SEQ ID NO: 57 - protein, 345 aa, Sulfolobus islandicus
MEVPLYNIFGDNYIIQVATEAENSTIYNNKVEIDDEELRNVLNLAYKIAKNNEDAAAERRGKAKKKKGEEGETTTSNIILPLSGNDKNPWTETLKCYNFPTTVALSEVFKNFSQVKECEEVSAPSFVKPEFYKFGRSPGMVERTRRVKLEVEPHYLIMAAAGWVLTRLGKAKVSEGDYVGVNVFTPTRGILYSLIQNVNGIVPGIKPETAFGLWIARKVVSSVTNPNVSVVSIYTISDAVGQNPTTINGGFSIDLTKLLEKRDLLSERLEAIARNALSISSNMRERYIVLANYIYEYLTGSKRLEDLLYFANRDLIMNLNSDDGKVRDLKLISAYVNGELIRGEG

SEQ ID NO: 58 - protein, 1193 aa, Unknown
  uncultured Parcubacteria group bacterium
MSKRHPRISGVKGYRLHAQRLEYTGKSGAMRTIKYPLYSSPSGGRTVPREIVSAINDDYVGLYGLSNFDDLYNAEKRNEEKVYSVLDFWYDCVQYGAVFSYTAPGLLKNVAEVRGGSYELTKTLKGSHLYDELQIDKVIKFLNKKEISRANGSLDKLKKDIIDCFKAEYRERHKDQCNKLADDIKNAKKDAGASLGERQKKLFRDFFGISEQSENDKPSFTNPLNLTCCLLPFDTVNNNRNRGEVLFNKLKEYAQKLDKNEGSLEMWEYIGIGNSGTAFSNFLGEGFLGRLRENKITELKKAMMDITDAWRGQEQEEELEKRLRILAALTIKLREPKFDNHWGGYRSDINGKLSSWLQNYINQTVKIKEDLKGHKKDLKKAKEMINRFGESDTKEEAVVSSLLESIEKIVPDDSADDEKPDIPAIAIYRRFLSDGRLTLNRFVQREDVQEALIKERLEAEKKKKPKKRKKKSDAEDEKETIDFKELFPHLAKPLKLVPNFYGDSKRELYKKYKNAAIYTDALWKAVEKIYKSAFSSSLKNSFFDTDFDKDFFIKRLQKIFSVYRRFNTDKWKPIVKNSFAPYCDIVSLAENEVLYKPKQSRSRKSAAIDKNRVRLPSTENIAKAGIALARELSVAGFDWKDLLKKEEHEEYIDLIELHKTALALLLAVTETQLDISALDFVENGTVKDFMKTRDGNLVLEGRFLEMFSQSIVFSELRGLAGLMSRKEFITRSAIQTMNGKQAELLYIPHEFQSAKITTPKEMSRAFLDLAPAEFATSLEPESLSEKSLLKLKQMRYYPHYFGYELTRTGQGIDGGVAENALRLEKSPVKKREIKCKQYKTLGRGQNKIVLYVRSSYYQTQFLEWFLHRPKNVQTDVAVSGSFLIDEKKVKTRWNYDALTVALEPVSGSERVFVSQPFTIFPEKSAEEEGQRYLGIDIGEYGIAYTALEITGDSAKILDQNFISDPQLKTLREEVKGLKLDQRRGTFAMPSTKIARIRESLVHSLRNRIHHLALKHKAKIVYELEVSRFEEGKQKIKKVYATLKKADVYSEIDADKNLQTTVWGKLAVASEISASYTSQFCGACKKLWRAEMQVDETITTQELIGTVRVIKGGTLIDAIKDFMRPPIFDENDTPFPKYRDFCDKHHISKKMRGNSCLFICPFCRANADADIQASQTIALLRYVKEEKKVEDYFE

SEQ ID NO: 59 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 60 - protein, 1300 aa, Artificial Sequence
  Synthetic
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIARGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 61 - protein, 1300 aa, Artificial Sequence
  Synthetic
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFADLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 62 - protein, 1300 aa, Artificial Sequence
  Synthetic
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDAAANGAYHIGLKGLMLLGRIKNNQEGKKLNLVIKNEEYFEFVQNRNN

SEQ ID NO: 63 - protein, 1300 aa, Artificial Sequence
  Synthetic
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIARGERHLAYYTLVDGKGNIIKQDTFNIIGNDRMKTNYHDKLAAIEKDRDSARKDWKKINNIKEMKEGYLSQVVHEIAKLVIEYNAIVVFADLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 64 - protein, 1300 aa, Artificial Sequence
  Synthetic
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIARGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDAAANGAYHIGLKGLMLLGRIKNNQEGKKLNLVIKNEEYFEFVQNRNN

SEQ ID NO: 65 - protein, 1300 aa, Artificial Sequence
  Synthetic
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFADLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDAAANGAYHIGLKGLMLLGRIKNNQEGKKLNLVIKNEEYFEFVQNRNN

SEQ ID NO: 66 - protein, 1300 aa, Artificial Sequence
  Synthetic
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIARGERHLAYYTLVDGKGNIIKQDTFNIIGNDRMKTNYHDKLAAIEKDRDSARKDWKKINNIKEMKEGYLSQVVHEIAKLVIEYNAIVVFADLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDAAANGAYHIGLKGLMLLGRIKNNQEGKKLNLVIKNEEYFEFVQNRNN

SEQ ID NO: 67 - protein, 887 aa, Natronobacterium gregoryi
MTVIDLDSTTTADELTSGHTYDISVTLTGVYDNTDEQHPRMSLAFEQDNGERRYITLWKNTTPKDVFTYDYATGSTYIFTNIDYEVKDGYENLTATYQTTVENATAQEVGTTDEDETFAGGEPLDHHLDDALNETPDDAETESDSGHVMTSFASRDQLPEWTLHTYTLTATDGAKTDTEYARRTLAYTVRQELYTDHDAAPVATDGLMLLTPEPLGETPLDLDCGVRVEADETRTLDYTTAKDRLLARELVEEGLKRSLWDDYLVRGIDEVLSKEPVLTCDEFDLHERYDLSVEVGHSGRAYLHINFRHRFVPKLTLADIDDDNIYPGLRVKTTYRPRRGHIVWGLRDECATDSLNTLGNQSVVAYHRNNQTPINTDLLDAIEAADRRVVETRRQGHGDDAVSFPQELLAVEPNTHQIKQFASDGFHQQARSKTRLSASRCSEKAQAFAERLDPVRLNGSTVEFSSEFFTGNNEQQLRLLYENGESVLTFRDGARGAHPDETFSKGIVNPPESFEVAVVLPEQQADTCKAQWDTMADLLNQAGAPPTRSETVQYDAFSSPESISLNVAGAIDPSEVDAAFVVLPPDQEGFADLASPTETYDELKKALANMGIYSQMAYFDRFRDAKIFYTRNVALGLLAAAGGVAFTTEHAMPGDADMFIGIDVSRSYPEDGASGQINIAATATAVYKDGTILGHSSTRPQLGEKLQSTDVRDIMKNAILGYQQVTGESPTHIVIHRDGFMNEDLDPATEFLNEQGVEYDIVEIRKQPQTRLLAVSDVQYDTPVKSIAAINQNEPRATVATFGAPEYLATRDGGGLPRPIQIERVAGETDIETLTRQVYLLSQSHIQVHNSTARLPITTAYADQASTHATKGYLVQTGAFESNVGFL

SEQ ID NO: 68 - protein, 1129 aa, Alicyclobacillus acidoterrestris
MAVKSIKVKLRLDDMPEIRAGLWKLHKEVNAGVRYYTEWLSLLRQENLYRRSPNGDGEQECDKTAEECKAELLERLRARQVENGHRGPAGSDDELLQLARQLYELLVPQAIGAKGDAQQIARKFLSPLADKDAVGGLGIAKAGNKPRWVRMREAGEPGWEEEKEKAETRKSADRTADVLRALADFGLKPLMRVYTDSEMSSVEWKPLRKGQAVRTWDRDMFQQAIERMMSWESWNQRVGQEYAKLVEQKNRFEQKNFVGQEHLVHLVNQLQQDMKEASPGLESKEQTAHYVTGRALRGSDKVFEKWGKLAPDAPFDLYDAEIKNVQRRNTRRFGSHDLFAKLAEPEYQALWREDASFLTRYAVYNSILRKLNHAKMFATFTLPDATAHPIWTRFDKLGGNLHQYTFLFNEFGERRHAIRFHKLLKVENGVAREVDDVTVPISMSEQLDNLLPRDPNEPIALYFRDYGAEQHFTGEFGGAKIQCRRDQLAHMHRRRGARDVYLNVSVRVQSQSEARGERRPPYAAVFRLVGDNHRAFVHFDKLSDYLAEHPDDGKLGSEGLLSGLRVMSVDLGLRTSASISVFRVARKDELKPNSKGRVPFFFPIKGNDNLVAVHERSQLLKLPGETESKDLRAIREERQRTLRQLRTQLAYLRLLVRCGSEDVGRRERSWAKLIEQPVDAANHMTPDWREAFENELQKLKSLHGICSDKEWMDAVYESVRRVWRHMGKQVRDWRKDVRSGERPKIRGYAKDVVGGNSIEQIEYLERQYKFLKSWSFFGKVSGQVIRAEKGSRFAITLREHIDHAKEDRLKKLADRIIMEALGYVYALDERGKGKWVAKYPPCQLILLEELSEYQFNNDRPPSENNQLMQWSHRGVFQELINQAQVHDLLVGTMYAAFSSRFDARTGAPGIRCRRVPARCTQEHNPEPFPWWLNKFVVEHTLDACPLRADDLIPTGEGEIFVSPFSAEEGDFHQIHADLNAAQNLQQRLWSDFDISQIRLRCDWGEVDGELVLIPRLTGKRTADSYSNKVFYTNTGVTYYERERGKKRRKVFAQEKLSEEEAELLVEADEAREKSVVLMRDPSGIINRGNWTRQKEFWSMVNQRIEGYLVKQIRSRVPLQDSACENTGDI

SEQ ID NO: 69 - protein, 1389 aa, Leptotrichia shahii
MGNLFGHKRWYEVRDKKDFKIKRKVKVKRNYDGNKYILNINENNNKEKIDNNKFIRKYINYKKNDNILKEFTRKFHAGNILFKLKGKEGIIRIENNDDFLETEEVVLYIEAYGKSEKLKALGITKKKIIDEAIRQGITKDDKKIEIKRQENEEEIEIDIRDEYTNKTLNDCSIILRIIENDELETKKSIYEIFKNINMSLYKIIEKIIENETEKVFENRYYEEHLREKLLKDDKIDVILTNFMEIREKIKSNLEILGFVKFYLNVGGDKKKSKNKKMLVEKILNINVDLTVEDIADFVIKELEFWNITKRIEKVKKVNNEFLEKRRNRTYIKSYVLLDKHEKFKIERENKKDKIVKFFVENIKNNSIKEKIEKILAEFKIDELIKKLEKELKKGNCDTEIFGIFKKHYKVNFDSKKFSKKSDEEKELYKIIYRYLKGRIEKILVNEQKVRLKKMEKIEIEKILNESILSEKILKRVKQYTLEHIMYLGKLRHNDIDMTTVNTDDFSRLHAKEELDLELITFFASTNMELNKIFSRENINNDENIDFFGGDREKNYVLDKKILNSKIKIIRDLDFIDNKNNITNNFIRKFTKIGTNERNRILHAISKERDLQGTQDDYNKVINIIQNLKISDEEVSKALNLDVVFKDKKNIITKINDIKISEENNNDIKYLPSFSKVLPEILNLYRNNPKNEPFDTIETEKIVLNALIYVNKELYKKLILEDDLEENESKNIFLQELKKTLGNIDEIDENIIENYYKNAQISASKGNNKAIKKYQKKVIECYIGYLRKNYEELFDFSDFKMNIQEIKKQIKDINDNKTYERITVKTSDKTIVINDDFEYIISIFALLNSNAVINKIRNRFFATSVWLNTSEYQNIIDILDEIMQLNTLRNECITENWNLNLEEFIQKMKEIEKDFDDFKIQTKKEIFNNYYEDIKNNILTEFKDDINGCDVLEKKLEKIVIFDDETKFEIDKKSNILQDEQRKLSNINKKDLKKKVDQYIKDKDQEIKSKILCRIIFNSDFLKKYKKEIDNLIEDMESENENKFQEIYYPKERKNELYIYKKNLFLNIGNPNFDKIYGLISNDIKMADAKFLFNIDGKNIRKNKISEIDAILKNLNDKLNGYSKEYKEKYIKKLKENDDFFAKNIQNKNYKSFEKDYNRVSEYKKIRDLVEFNYLNKIESYLIDINWKLAIQMARFERDMHYIVNGLRELGIIKLSGYNTGISRAYPKRNGSDGFYTTTAYYKFFDEESYKKFEKICYGFGIDLSENSEINKPENESIRNYISHFYIVRNPFADYSIAEQIDRVSNLLSYSTRYNNSTYASVFEVFKKDVNLDYDELKKKFKLIGNNDILERLMKPKKVSVLELESYNSDYIKNLIIELLTKIENTNDTL

SEQ ID NO: 70 - protein, 1052 aa, Staphylococcus aureus
KRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 71 - DNA, 23 bp, Artificial Sequence
  Synthetic
tttagtccttaaaatgtaggggg

SEQ ID NO: 72 - protein, 198 aa, Homo sapiens [sequence omitted]

SEQ ID NO: 73 - protein, 198 aa, Mus musculus
MDSLLMKQKKFLYHFKNVRWAKGRHETYLCYVVKRRDSATSCSLDFGHLRNKSGCHVELLFLRYISDWDLDPGRCYRVTWFTSWSPCYDCARHVAEFLRWNPNLSLRIFTARLYFCEDRKAEPEGLRRLHRAGVQIGIMTFKDYFYCWNTFVENRERTFKAWEGLHENSVRLTRQLRRILLPLYEVDDLRDAFRMLGF

SEQ ID NO: 74 - protein, 198 aa, Canis familiaris
MDSLLMKQRKFLYHFKNVRWAKGRHETYLCYVVKRRDSATSFSLDFGHLRNKSGCHVELLFLRYISDWDLDPGRCYRVTWFTSWSPCYDCARHVADFLRGYPNLSLRIFAARLYFCEDRKAEPEGLRRLHRAGVQIAIMTFKDYFYCWNTFVENREKTFKAWEGLHENSVRLSRQLRRILLPLYEVDDLRDAFRTLGL

SEQ ID NO: 75 - protein, 199 aa, Bos taurus
MDSLLKKQRQFLYQFKNVRWAKGRHETYLCYVVKRRDSPTSFSLDFGHLRNKAGCHVELLFLRYISDWDLDPGRCYRVTWFTSWSPCYDCARHVADFLRGYPNLSLRIFTARLYFCDKERKAEPEGLRRLHRAGVQIAIMTFKDYFYCWNTFVENHERTFKAWEGLHENSVRLSRQLRRILLPLYEVDDLRDAFRTLGL

SEQ ID NO: 76 - protein, 239 aa, Rattus rattus
MAVGSKPKAALVGPHWERERIWCFLCSTGLGTQQTGQTSRWLRPAATQDPVSPPRSLLMKQRKFLYHFKNVRWAKGRHETYLCYVVKRRDSATSFSLDFGYLRNKSGCHVELLFLRYISDWDLDPGRCYRVTWFTSWSPCYDCARHVADFLRGNPNLSLRIFTARLTGWGALPAGLMSPARPSDYFYCWNTFVENHERTFKAWEGLHENSVRLSRRLRRILLPLYEVDDLRDAFRTLGL

SEQ ID NO: 77 - protein, 429 aa, Mus musculus
MGPFCLGCSHRKCYSPIRNLISQETFKFHFKNLGYAKGRKDTFLCYEVTRKDCDSPVSLHHGVFKNKDNIHAEICFLYWFHDKVLKVLSPREEFKITWYMSWSPCFECAEQIVRFLATHHNLSLDIFSSRLYNVQDPETQQNLCRLVQEGAQVAAMDLYEFKKCWKKFVDNGGRRFRPWKRLLTNFRYQDSKLQEILRPCYIPVPSSSSSTLSNICLTKGLPETRFCVEGRRMDPLSEEEFYSQFYNQRVKHLCYYHRMKPYLCYQLEQFNGQAPLKGCLLSEKGKQHAEILFLDKIRSMELSQVTITCYLTWSPCPNCAWQLAAFKRDRPDLILHIYTSRLYFHWKRPFQKGLCSLWQSGILVDVMDLPQFTDCWTNFVNPKRPFWPWKGLEIISRRTQRRLRRIKESWGLQDLVNDFGNLQLGPPMS

SEQ ID NO: 78 - protein, 429 aa, Rattus rattus
MGPFCLGCSHRKCYSPIRNLISQETFKFHFKNLRYAIDRKDTFLCYEVTRKDCDSPVSLHHGVFKNKDNIHAEICFLYWFHDKVLKVLSPREEFKITWYMSWSPCFECAEQVLRFLATHHNLSLDIFSSRLYNIRDPENQQNLCRLVQEGAQVAAMDLYEFKKCWKKFVDNGGRRFRPWKKLLTNFRYQDSKLQEILRPCYIPVPSSSSSTLSNICLTKGLPETRFCVERRRVHLLSEEEFYSQFYNQRVKHLCYYHGVKPYLCYQLEQFNGQAPLKGCLLSEKGKQHAEILFLDKIRSMELSQVIITCYLTWSPCPNCAWQLAAFKRDRPDLILHIYTSRLYFHWKRPFQKGLCSLWQSGILVDVMDLPQFTDCWTNFVNPKRPFWPWKGLEIISRRTQRRLHRIKESWGLQDLVNDFGNLQLGPPMS

SEQ ID NO: 79 - protein, 370 aa, Rhesus macaque
MVEPMDPRTFVSNFNNRPILSGLNTVWLCCEVKTKDPSGPPLDAKIFQGKVYSKAKYHPEMRFLRWFHKWRQLHHDQEYKVTWYVSWSPCTRCANSVATFLAKDPKVTLTIFVARLYYFWKPDYQQALRILCQKRGGPHATMKIMNYNEFQDCWNKFVDGRGKPFKPRNNLPKHYTLLQATLGELLRHLMDPGTFTSNFNNKPWVSGQHETYLCYKVERLHNDTWVPLNQHRGFLRNQAPNIHGFPKGRHAELCFLDLIPFWKLDGQQYRVTCFTSWSPCFSCAQEMAKFISNNEHVSLCIFAARIYDDQGRYQEGLRALHRDGAKIAMMNYSEFEYCWDTFVDRQGRPFQPWDGLDEHSQALSGRLRAI

SEQ ID NO: 80 - protein, 384 aa, Pan troglodytes
MKPHFRNPVERMYQDTFSDNFYNRPILSHRNTVWLCYEVKTKGPSRPPLDAKIFRGQVYSKLKYHPEMRFFHWFSKWRKLHRDQEYEVTWYISWSPCTKCTRDVATFLAEDPKVTLTIFVARLYYFWDPDYQEALRSLCQKRDGPRATMKIMNYDEFQHCWSKFVYSQRELFEPWNNLPKYYILLHIMLGEILRHSMDPPTFTSNFNNELWVRGRHETYLCYEVERLHNDTWVLLNQRRGFLCNQAPHKHGFLEGRHAELCFLDVIPFWKLDLHQDYRVTCFTSWSPCFSCAQEMAKFISNNKHVSLCIFAARIYDDQGRCQEGLRTLAKAGAKISIMTYSEFKHCWDTFVDHQGCPFQPWDGLEEHSQALSGRLRAILQNQGN

SEQ ID NO: 81 - protein, 377 aa, Chlorocebus sabaeus
MNPQIRNMVEQMEPDIFVYYFNNRPILSGRNTVWLCYEVKTKDPSGPPLDANIFQGKLYPEAKDHPEMKFLHWFRKWRQLHRDQEYEVTWYVSWSPCTRCANSVATFLAEDPKVTLTIFVARLYYFWKPDYQQALRILCQERGGPHATMKIMNYNEFQHCWNEFVDGQGKPFKPRKNLPKHYTLLHATLGELLRHVMDPGTFTSNFNNKPWVSGQRETYLCYKVERSHNDTWVLLNQHRGFLRNQAPDRHGFPKGRHAELCFLDLIPFWKLDDQQYRVTCFTSWSPCFSCAQKMAKFISNNKHVSLCIFAARIYDDQGRCQEGLRTLHRDGAKIAVMNYSEFEYCWDTFVDRQGRPFQPWDGLDEHSQALSGRLRAI

SEQ ID NO: 82 - protein, 384 aa, Homo sapiens
MKPHFRNTVERMYRDTFSYNFYNRPILSRRNTVWLCYEVKTKGPSRPPLDAKIFRGQVYSELKYHPEMRFFHWFSKWRKLHRDQEYEVTWYISWSPCTKCTRDMATFLAEDPKVTLTIFVARLYYFWDPDYQEALRSLCQKRDGPRATMKIMNYDEFQHCWSKFVYSQRELFEPWNNLPKYYILLHIMLGEILRHSMDPPTFTFNFNNEPWVRGRHETYLCYEVERMHNDTWVLLNQRRGFLCNQAPHKHGFLEGRHAELCFLDVIPFWKLDLDQDYRVTCFTSWSPCFSCAQEMAKFISKNKHVSLCIFTARIYDDQGRCQEGLRTLAEAGAKISIMTYSEFKHCWDTFVDHQGCPFQPWDGLDEHSQDLSGRLRAILQNQEN

SEQ ID NO: 83 - protein, 373 aa, Homo sapiens
MKPHFRNTVERMYRDTFSYNFYNRPILSRRNTVWLCYEVKTKGPSRPRLDAKIFRGQVYSQPEHHAEMCFLSWFCGNQLPAYKCFQITWFVSWTPCPDCVAKLAEFLAEHPNVTLTISAARLYYYWERDYRRALCRLSQAGARVKIMDDEEFAYCWENFVYSEGQPFMPWYKFDDNYAFLHRTLKEILRNPMEAMYPHIFYFHFKNLRKAYGRNESWLCFTMEVVKHHSPVSWKRGVFRNQVDPETHCHAERCFLSWFCDDILSPNTNYEVTWYTSWSPCPECAGEVAEFLARHSNVNLTIFTARLYYFWDTDYQEGLRSLSQEGASVEIMGYKDFKYCWENFVYNDDEPFKPWKGLKYNFLFLDSKLQEILE

SEQ ID NO: 84 - protein, 382 aa, Homo sapiens
MNPQIRNPMERMYRDTFYDNFENEPILYGRSYTWLCYEVKIKRGRSNLLWDTGVFRGQVYFKPQYHAEMCFLSWFCGNQLPAYKCFQITWFVSWTPCPDCVAKLAEFLSEHPNVTLTISAARLYYYWERDYRRALCRLSQAGARVTIMDYEEFAYCWENFVYNEGQQFMPWYKFDENYAFLHRTLKEILRYLMDPDTFTFNFNNDPLVLRRRQTYLCYEVERLDNGTWVLMDQHMGFLCNEAKNLLCGFYGRHAELRFLDLVPSLQLDPAQIYRVTWFISWSPCFSWGCAGEVRAFLQENTHVRLRIFAARIYDYDPLYKEALQMLRDAGAQVSIMTYDEFEYCWDTFVYRQGCPFQPWDGLEEHSQALSGRLRAILQNQGN

SEQ ID NO: 85 - protein, 396 aa, Rattus rattus
MQPQGLGPNAGMGPVCLGCSHRRPYSPIRNPLKKLYQQTFYFHFKNVRYAWGRKNNFLCYEVNGMDCALPVPLRQGVFRKQGHIHAELCFIYWFHDKVLRVLSPMEEFKVTWYMSWSPCSKCAEQVARFLAAHRNLSLAIFSSRLYYYLRNPNYQQKLCRLIQEGVHVAAMDLPEFKKCWNKFVDNDGQPFRPWMRLRINFSFYDCKLQEIFSRMNLLREDVFYLQFNNSHRVKPVQNRYYRRKSYLCYQLERANGQEPLKGYLLYKKGEQHVEILFLEKMRSMELSQVRITCYLTWSPCPNCARQLAAFKKDHPDLILRIYTSRLYFYWRKKFQKGLCTLWRSGIHVDVMDLPQFADCWTNFVNPQRPFRPWNELEKNSWRIQRRLRRIKESWGL

SEQ ID NO: 86 - protein, 227 aa, Bos taurus
DGWEVAFRSGTVLKAGVLGVSMTEGWAGSGHPGQGACVWTPGTRNTMNLLREVLFKQQFGNQPRVPAPYYRRKTYLCYQLKQRNDLTLDRGCFRNKKQRHAEIRFIDKINSLDLNPSQSYKIICYITWSPCPNCANELVNFITRNNHLKLEIFASRLYFHWIKSFKMGLQDLQNAGISVAVMTHTEFEDCWEQFVDNQSRPFQPWDKLEQYSASIRRRLQRILTAPI

SEQ ID NO: 87 - protein, 490 aa, Chlorocebus sabaeus
MNPQIRNPMEWMYQRTFYYNFENEPILYGRSYTWLCYEVKIRRGHSNLLWDTGVFRGQMYSQPEHHAEMCFLSWFCGNQLSAYKCFQITWFVSWTPCPDCVAKLAKFLAEHPNVTLTISAARLYYYWERDYRRALCRLSQAGARVKIMDDEEFAYCWENFVYNEGQPFMPWYKFDDNYAFLHRTLKEIIRHLMDPDTFTFNFNNDPLVLRRHQTYLCYEVERLDNGTWVLMDQHMGFLCNEAKNLLCGFYGRHAELRFLDLVPSLQLDPAQIYRVTWFISWSPCFSWGCAGQVRAFLQENTHVRLRIFAARIYDYDPLYKEALQMLRDAGAQVSIMTYDEFEYCWDTFVYRQGCPFQPWDGLEEHSQALSGRLRAILQVRASSLCMVPHRPPPPPQSPGPCLPLCSEPPLGSLLPTGRPAPSLPFLLTASFSFPPPASLPPLPSLSLSPGHLPVPSFHSLTSCSIQPPCSSRIRETEGWASVSKEGRDLG

SEQ ID NO: 88 - protein, 190 aa, Homo sapiens
MNPQIRNPMKAMYPGTFYFQFKNLWEANDRNETWLCFTVEGIKRRSVVSWKTGVFRNQVDSETHCHAERCFLSWFCDDILSPNTKYQVTWYTSWSPCPDCAGEVAEFLARHSNVNLTIFTARLYYFQYPCYQEGLRSLSQEGVAVEIMDYEDFKYCWENFVYNDNEPFKPWKGLKTNFRLLKRRLRESLQ

SEQ ID NO: 89 - protein, 190 aa, Troglodytes gorilla
MNPQIRNPMKAMYPGTFYFQFKNLWEANDRNETWLCFTVEGIKRRSVVSWKTGVFRNQVDSETHCHAERCFLSWFCDDILSPNTNYQVTWYTSWSPCPECAGEVAEFLARHSNVNLTIFTARLYYFQDTDYQEGLRSLSQEGVAVKIMDYKDFKYCWENFVYNDDEPFKPWKGLKYNFRFLKRRLQEILE

SEQ ID NO: 90 - protein, 199 aa, Homo sapiens
MEASPASGPRHLMDPHIFTSNFNNGIGRHKTYLCYEVERLDNGTSVKMDQHRGFLHNQAKNLLCGFYGRHAELRFLDLVPSLQLDPAQIYRVTWFISWSPCFSWGCAGEVRAFLQENTHVRLRIFAARIYDYDPLYKEALQMLRDAGAQVSIMTYDEFKHCWDTFVDHQGCPFQPWDGLDEHSQALSGRLRAILQNQGN

SEQ ID NO: 91 - protein, 202 aa, Rhesus macaque
MDGSPASRPRHLMDPNTFTFNFNNDLSVRGRHQTYLCYEVERLDNGTWVPMDERRGFLCNKAKNVPCGDYGCHVELRFLCEVPSWQLDPAQTYRVTWFISWSPCFRRGCAGQVRVFLQENKHVRLRIFAARIYDYDPLYQEALRTLRDAGAQVSIMTYEEFKHCWDTFVDRQGRPFQPWDGLDEHSQALSGRLRAILQNQGN

SEQ ID NO: 92 - protein, 185 aa, Bos taurus
MDEYTFTENFNNQGWPSKTYLCYEMERLDGDATIPLDEYKGFVRNKGLDQPEKPCHAELYFLGKIHSWNLDRNQHYRLTCFISWSPCYDCAQKLTTFLKENHHISLHILASRIYTHNRFGCHQSGLCELQAAGARITIMTFEDFKHCWETFVDHKGKPFQPWEGLNVKSQALCTELQAILKTQQN

SEQ ID NO: 93 - protein, 200 aa, Homo sapiens
MALLTAETFRLQFNNKRRLRRPYYPRKALLCYQLTPQNGSTPTRGYFENKKKCHAEICFINEIKSMGLDETQCYQVTCYLTWSPCSSCAWELVDFIKAHDHLNLGIFASRLYYHWCKPQQKGLRLLCGSQVPVEVMGFPKFADCWENFVDHEKPLSFNPYKMLEELDKNSRAIKRRLERIKIPGVRAQGRYMDILCDAEV

SEQ ID NO: 94 - protein, 210 aa, Rhesus macaque
MALLTAKTFSLQFNNKRRVNKPYYPRKALLCYQLTPQNGSTPTRGHLKNKKKDHAEIRFINKIKSMGLDETQCYQVTCYLTWSPCPSCAGELVDFIKAHRHLNLRIFASRLYYHWRPNYQEGLLLLCGSQVPVEVMGLPEFTDCWENFVDHKEPPSFNPSEKLEELDKNSQAIKRRLERIKSRSVDVLENGLRSLQLGPVTPSSSIRNSR

SEQ ID NO: 95 - protein, 386 aa, Homo sapiens
MNPQIRNPMERMYRDTFYDNFENEPILYGRSYTWLCYEVKIKRGRSNLLWDTGVFRGPVLPKRQSNHRQEVYFRFENHAEMCFLSWFCGNRLPANRRFQITWFVSWNPCLPCVVKVTKFLAEHPNVTLTISAARLYYYRDRDWRWVLLRLHKAGARVKIMDYEDFAYCWENFVCNEGQPFMPWYKFDDNYASLHRTLKEILRNPMEAMYPHIFYFHFKNLLKACGRNESWLCFTMEVTKHHSAVFRKRGVFRNQVDPETHCHAERCFLSWFCDDILSPNTNYEVTWYTSWSPCPECAGEVAEFLARHSNVNLTIFTARLCYFWDTDYQEGLCSLSQEGASVKIMGYKDFVSCWKNFVYSDDEPFKPWKGLQTNFRLLKRRLREILQ

SEQ ID NO: 96 - protein, 236 aa, Homo sapiens
MTSEKGPSTGDPTLRRRIEPWEFDVFYDPRELRKEACLLYEIKWGMSRKIWRSSGKNTTNHVEVNFIKKFTSERDFHPSMSCSITWFLSWSPCWECSQAIREFLSRHPGVTLVIYVARLFWHMDQQNRQGLRDLVNSGVTIQIMRASEYYHCWRNFVNYPPGDEAHWPQYPPLWMMLYALELHCIILSLPPCLKISRRWQNHLTFFRLHLQNCHYQTIPPHILLATGLIHPSVAWR

SEQ ID NO: 97 - protein, 229 aa, Mus musculus
MSSETGPVAVDPTLRRRIEPHEFEVFFDPRELRKETCLLYEINWGGRHSVWRHTSQNTSNHVEVNFLEKFTTERYFRPNTRCSITWFLSWSPCGECSRAITEFLSRHPYVTLFIYIARLYHHTDQRNRQGLRDLISSGVTIQIMTEQEYCYCWRNFVNYPPSNEAYWPRYPHLWVKLYVLELYCIILGLPPCLKILRRKQPQLTFFTITLQTCHYQRIPPHLLWATGLK

SEQ ID NO: 98 - protein, 229 aa, Rattus rattus [sequence omitted]

SEQ ID NO: 99 - protein, 224 aa, Homo sapiens
MAQKEEAAVATEAASQNGEDLENLDDPEKLKELIELPPFEIVTGERLPANFFKFQFRNVEYSSGRNKTFLCYVVEAQGKGGQVQASRGYLEDEHAAAHAEEAFFNTILPAFDPALRYNVTWYVSSSPCAACADRIIKTLSKTKNLRLLILVGRLFMWEEPEIQAALKKLKEAGCKLRIMKPQDFEYVWQNFVEQEEGESKAFQPWEDIQENFLYYEEKLADILK

SEQ ID NO: 100 - protein, 224 aa, Mus musculus
MAQKEEAAEAAAPASQNGDDLENLEDPEKLKELIDLPPFEIVTGVRLPVNFFKFQFRNVEYSSGRNKTFLCYVVEVQSKGGQAQATQGYLEDEHAGAHAEEAFFNTILPAFDPALKYNVTWYVSSSPCAACADRILKTLSKTKNLRLLILVSRLFMWEEPEVQAALKKLKEAGCKLRIMKPQDFEYIWQNFVEQEEGESKAFEPWEDIQENFLYYEEKLADILK

SEQ ID NO: 101 - protein, 224 aa, Rattus rattus
MAQKEEAAEAAAPASQNGDDLENLEDPEKLKELIDLPPFEIVTGVRLPVNFFKFQFRNVEYSSGRNKTFLCYVVEAQSKGGQVQATQGYLEDEHAGAHAEEAFFNTILPAFDPALKYNVTWYVSSSPCAACADRILKTLSKTKNLRLLILVSRLFMWEEPEVQAALKKLKEAGCKLRIMKPQDFEYLWQNFVEQEEGESKAFEPWEDIQENFLYYEEKLADILK

SEQ ID NO: 102 - protein, 224 aa, Bos taurus
MAQKEEAAAAAEPASQNGEEVENLEDPEKLKELIELPPFEIVTGERLPAHYFKFQFRNVEYSSGRNKTFLCYVVEAQSKGGQVQASRGYLEDEHATNHAEEAFFNSIMPTFDPALRYMVTWYVSSSPCAACADRIVKTLNKTKNLRLLILVGRLFMWEEPEIQAALRKLKEAGCRLRIMKPQDFEYIWQNFVEQEEGESKAFEPWEDIQENFLYYEEKLADILK

SEQ ID NO: 103 - protein, 208 aa, Petromyzon marinus
MTDAEYVRIHEKLDIYTFKKQFFNNKKSVSHRCYVLFELKRRGERRACFWGYAVNKPQSGTERGIHAEIFSIRKVEEYLRDNPGQFTINWYSSWSPCADCAEKILEWYNQELRGNGHTLKIWACKLYYEKNARNQIGLWNLRDNGVGLNVMVSEHYQCCRKIFIQSSHNQLNENRWLEKTLKRAEKRRSELSIMIQVKILHTTKSPAV

SEQ ID NO: 104 - protein, 384 aa, Homo sapiens
MKPHFRNTVERMYRDTFSYNFYNRPILSRRNTVWLCYEVKTKGPSRPPLDAKIFRGQVYSELKYHPEMRFFHWFSKWRKLHRDQEYEVTWYISWSPCTKCTRDMATFLAEDPKVTLTIFVARLYYFWDPDYQEALRSLCQKRDGPRATMKIMNYDEFQHCWSKFVYSQRELFEPWNNLPKYYILLHIMLGEILRHSMDPPTFTFNFNNEPWVRGRHETYLCYEVERMHNDTWVLLNQRRGFLCNQAPHKHGFLEGRHAELCFLDVIPFWKLDLDQDYRVTCFTSWSPCFSCAQEMAKFISKNKHVSLCIFTARIYRRQGRCQEGLRTLAEAGAKISIMTYSEFKHCWDTFVDHQGCPFQPWDGLDEHSQDLSGRLRAILQNQEN

SEQ ID NO: 105 - protein, 184 aa, Homo sapiens
MDPPTFTFNFNNEPWVRGRHETYLCYEVERMHNDTWVLLNQRRGFLCNQAPHKHGFLEGRHAELCFLDVIPFWKLDLDQDYRVTCFTSWSPCFSCAQEMAKFISKNKHVSLCIFTARIYDDQGRCQEGLRTLAEAGAKISIMTYSEFKHCWDTFVDHQGCPFQPWDGLDEHSQDLSGRLRAILQ

SEQ ID NO: 106 - protein, 184 aa, Homo sapiens
MDPPTFTFNFNNEPWVRGRHETYLCYEVERMHNDTWVLLNQRRGFLCNQAPHKHGFLEGRHAELCFLDVIPFWKLDLDQDYRVTCFTSWSPCFSCAQEMAKFISKNKHVSLCIFTARIYRRQGRCQEGLRTLAEAGAKISIMTYSEFKHCWDTFVDHQGCPFQPWDGLDEHSQDLSGRLRAILQ

SEQ ID NO: 107 - protein, 1368 aa, Streptococcus pyogenes [sequence omitted]

SEQ ID NO: 108 - protein, 83 aa, Artificial Sequence
  Synthetic
TNLSDIIEKETGKQLVIQESILMLPEEVEEVIGNKPESDILVHTAYDESTDENVMLLTSDAPEYKPWALVIQDSNGENKIKML

SEQ ID NO: 109 - protein, 120 aa, Artificial Sequence
  Synthetic
  MISC_FEATURE (5)..(120): may be absent
GGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGS

SEQ ID NO: 110 - protein, 150 aa, Artificial Sequence
  Synthetic
  MISC_FEATURE (6)..(150): may be absent
GGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGS

SEQ ID NO: 111 - protein, 150 aa, Artificial Sequence
  Synthetic
  MISC_FEATURE (6)..(150): may be absent
EAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAK

SEQ ID NO: 112 - protein, 90 aa, Artificial Sequence
  Synthetic
  MISC_FEATURE (4)..(90): may be absent
GGSGGSGGSGGSGGSGGSGGSGGSGGSGGSGGSGGSGGSGGSGGSGGSGGSGGSGGSGGSGGSGGSGGSGGSGGSGGSGGSGGSGGSGGS

SEQ ID NO: 113 - protein, 120 aa, Artificial Sequence
  Synthetic
  MISC_FEATURE (5)..(120): may be absent
SGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGS

SEQ ID NO: 114 - protein, 16 aa, Artificial Sequence
  Synthetic
SGSETPGTSESATPES

SEQ ID NO: 115 - protein, 7 aa, Artificial Sequence
  Synthetic
PKKKRKV

SEQ ID NO: 116 - protein, 30 aa, Artificial Sequence
  Synthetic
MDSLLMNRRKFLYQFKNVRWAKGRRETYLC

SEQ ID NO: 117 - protein, 36 aa, Artificial Sequence
  Synthetic
  misc_feature (2)..(2): Xaa can be any naturally occurring amino acid
  misc_feature (4)..(26): Xaa can be any naturally occurring amino acid
  MISC_FEATURE (27)..(29): may be absent
  misc_feature (32)..(33): Xaa can be any naturally occurring amino acid
  MISC_FEATURE (34)..(35): may be absent
HXEXXXXXXXXXXXXXXXXXXXXXXXXXXPCXXXXC

SEQ ID NO: 118 - protein, 30 aa, Artificial Sequence
  Synthetic
  MISC_FEATURE (2)..(30): may be absent
GGGGGGGGGGGGGGGGGGGGGGGGGGGGGG

SEQ ID NO: 119 - protein, 16 aa, Artificial Sequence
  Synthetic
  misc_feature (3)..(12): Xaa can be any naturally occurring amino acid
KRXXXXXXXXXXKKKL

SEQ ID NO: 120 - protein, 60 aa, Artificial Sequence
  Synthetic
  misc_feature (1)..(1): Xaa can be any naturally occurring amino acid
  MISC_FEATURE (3)..(60): may be absent
XPXPXPXPXPXPXPXPXPXPXPXPXPXPXPXPXPXPXPXPXPXPXPXPXPXPXPXPXPXP

SEQ ID NO: 121 - DNA, 23 bp, Artificial Sequence
  Synthetic
  misc_feature (1)..(21): n is a, c, g, or t
nnnnnnnnnnnnnnnnnnnnngg

SEQ ID NO: 122 - DNA, 15 bp, Artificial Sequence
  Synthetic
  misc_feature (1)..(13): n is a, c, g, or t
nnnnnnnnnnnnngg

SEQ ID NO: 123 - DNA, 23 bp, Artificial Sequence
  Synthetic
  misc_feature (1)..(21): n is a, c, g, or t
nnnnnnnnnnnnnnnnnnnnngg

SEQ ID NO: 124 - DNA, 14 bp, Artificial Sequence
  Synthetic
  misc_feature (1)..(12): n is a, c, g, or t
nnnnnnnnnnnngg

SEQ ID NO: 125 - DNA, 27 bp, Artificial Sequence
  Synthetic
  misc_feature (1)..(22): n is a, c, g, or t
nnnnnnnnnnnnnnnnnnnnnnagaaw

SEQ ID NO: 126 - DNA, 19 bp, Artificial Sequence
  Synthetic
  misc_feature (1)..(14): n is a, c, g, or t
nnnnnnnnnnnnnnagaaw

SEQ ID NO: 127 - DNA, 27 bp, Artificial Sequence
  Synthetic
  misc_feature (1)..(22): n is a, c, g, or t
nnnnnnnnnnnnnnnnnnnnnnagaaw

SEQ ID NO: 128 - DNA, 18 bp, Artificial Sequence
  Synthetic
  misc_feature (1)..(13): n is a, c, g, or t
nnnnnnnnnnnnnagaaw

SEQ ID NO: 129 - DNA, 25 bp, Artificial Sequence
  Synthetic
  misc_feature (1)..(21): n is a, c, g, or t
  misc_feature (24)..(24): n is a, c, g, or t
nnnnnnnnnnnnnnnnnnnnnggng

SEQ ID NO: 130 - DNA, 17 bp, Artificial Sequence
  Synthetic
  misc_feature (1)..(13): n is a, c, g, or t
  misc_feature (16)..(16): n is a, c, g, or t
nnnnnnnnnnnnnggng

SEQ ID NO: 131 - DNA, 25 bp, Artificial Sequence
  Synthetic
  misc_feature (1)..(21): n is a, c, g, or t
  misc_feature (24)..(24): n is a, c, g, or t
nnnnnnnnnnnnnnnnnnnnnggng

SEQ ID NO: 132 - DNA, 16 bp, Artificial Sequence
  Synthetic
  misc_feature (1)..(12): n is a, c, g, or t
  misc_feature (15)..(15): n is a, c, g, or t
nnnnnnnnnnnnggng

SEQ ID NO: 133 - DNA, 125 bp, Artificial Sequence
  Synthetic
  misc_feature (1)..(8): n is a, c, g, or t
nnnnnnnngtttttgtactctcaagatttagaaataaatcttgcagaagctacaaagataaggcttcatgccgaaatcaacaccctgtcattttatggcagggtgttttcgttatttaatttttt

SEQ ID NO: 134 - DNA, 121 bp, Artificial Sequence
  Synthetic
  misc_feature (1)..(18): n is a, c, g, or t
nnnnnnnnnnnnnnnnnngtttttgtactctcagaaatgcagaagctacaaagataaggcttcatgccgaaatcaacaccctgtcattttatggcagggtgttttcgttatttaatttttt

SEQ ID NO: 135 - DNA, 109 bp, Artificial Sequence
  Synthetic
  misc_feature (1)..(20): n is a, c, g, or t
nnnnnnnnnnnnnnnnnnnngtttttgtactctcagaaatgcagaagctacaaagataaggcttcatgccgaaatcaacaccctgtcattttatggcagggtgtttttt

SEQ ID NO: 136 - DNA, 102 bp, Artificial Sequence
  Synthetic
  misc_feature (1)..(20): n is a, c, g, or t
nnnnnnnnnnnnnnnnnnnngttttagagctagaaatagcaagttaaaataaggctagtccgttatcaacttgaaaaagtggcaccgagtcggtgctttttt

SEQ ID NO: 137 - DNA, 88 bp, Artificial Sequence
  Synthetic
  misc_feature (1)..(20): n is a, c, g, or t
nnnnnnnnnnnnnnnnnnnngttttagagctagaaatagcaagttaaaataaggctagtccgttatcaacttgaaaaagtgttttttt

SEQ ID NO: 138 - DNA, 76 bp, Artificial Sequence
  Synthetic
  misc_feature (1)..(20): n is a, c, g, or t
nnnnnnnnnnnnnnnnnnnngttttagagctagaaatagcaagttaaaataaggctagtccgttatcatttttttt

SEQ ID NO: 139 - RNA, 82 nt, Artificial Sequence
  Synthetic
guuuuagagcuagaaauagcaaguuaaaauaaaggcuaguccguuaucaacuugaaaaaguggcaccgagucggugcuuuuu

SEQ ID NO: 140 - DNA, 23 bp, Artificial Sequence
  Synthetic
tatatgcatatttattacatcgg

SEQ ID NO: 141 - DNA, 23 bp, Artificial Sequence
  Synthetic
ccgtcatgtgggtcctgaattgg

SEQ ID NO: 142 - DNA, 23 bp, Artificial Sequence
  Synthetic
acactgaaagactccaggtcagg

SEQ ID NO: 143 - DNA, 23 bp, Artificial Sequence
  Synthetic
gtcagaagagatgtggtcaatgg

SEQ ID NO: 144 - DNA, 23 bp, Artificial Sequence
  Synthetic
tttaaagtgaagcagcatctggg

SEQ ID NO: 145 - DNA, 23 bp, Artificial Sequence
  Synthetic
atttaaagtgaagcagcatctgg

SEQ ID NO: 146 - DNA, 23 bp, Artificial Sequence
  Synthetic
actccatgacagtgtaattttgg

SEQ ID NO: 147 - DNA, 23 bp, Artificial Sequence
  Synthetic
gcctggagaagccatccagcagg

SEQ ID NO: 148 - DNA, 23 bp, Artificial Sequence
  Synthetic
ctcagacacactcattgatgagg

SEQ ID NO: 149 - DNA, 24 bp, Artificial Sequence
  Synthetic
gaggcactgcccccaccatgagcg

SEQ ID NO: 150 - DNA, 23 bp, Artificial Sequence
  Synthetic
gaacacaaagcatagactgcggg

SEQ ID NO: 151 - DNA, 23 bp, Artificial Sequence
  Synthetic
ggcccagactgagcacgtgatgg

SEQ ID NO: 152 - DNA, 23 bp, Artificial Sequence
  Synthetic
ggcactgcggctggaggtccggg

SEQ ID NO: 153 - DNA, 23 bp, Artificial Sequence
  Synthetic
gtcatcttagtcattacctgagg

SEQ ID NO: 154 - DNA, 23 bp, Artificial Sequence
  Synthetic
gagtccgagcagaagaagaaggg

SEQ ID NO: 155 - DNA, 24 bp, Artificial Sequence
  Synthetic
gttagtccttaaaatgtagggggg

SEQ ID NO: 156 - DNA, 24 bp, Artificial Sequence
  Synthetic
gttcccggtcatgcactacagagg

SEQ ID NO: 157 - DNA, 23 bp, Artificial Sequence
  Synthetic
gagtatgaggcatagactgcagg

SEQ ID NO: 158 - DNA, 23 bp, Artificial Sequence
  Synthetic
gatgagataatgatgagtcaggg

SEQ ID NO: 159 - DNA, 23 bp, Artificial Sequence
  Synthetic
gaagatagagaatagactgctgg

SEQ ID NO: 160 - DNA, 23 bp, Artificial Sequence
  Synthetic
gggaataaatcatagaatcctgg

SEQ ID NO: 161 - DNA, 23 bp, Artificial Sequence
  Synthetic
cttgaccaatagccttgacaagg

SEQ ID NO: 162 - DNA, 23 bp, Artificial Sequence
  Synthetic
atatttgcattgagatagtgtgg

SEQ ID NO: 163 - DNA, 25 bp, Artificial Sequence
  Synthetic
caccgttcccggtcatgcactacag

SEQ ID NO: 164 - DNA, 25 bp, Artificial Sequence
  Synthetic
aaacctgtagtgcatgaccgggaac

SEQ ID NO: 165 - DNA, 22 bp, Artificial Sequence
  Synthetic
ggtgtttcgtcctttccacaag

SEQ ID NO: 166 - DNA, 55 bp, Artificial Sequence
  Synthetic
gaacacaaagcatagactgcgttttagagctagaaatagcaagttaaaataaggc

SEQ ID NO: 167 - DNA, 55 bp, Artificial Sequence
  Synthetic
ggcccagactgagcacgtgagttttagagctagaaatagcaagttaaaataaggc

SEQ ID NO: 168 - DNA, 55 bp, Artificial Sequence
  Synthetic
ggcactgcggctggaggtgggttttagagctagaaatagcaagttaaaataaggc

SEQ ID NO: 169 - DNA, 55 bp, Artificial Sequence
  Synthetic
gtcatcttagtcattacctggttttagagctagaaatagcaagttaaaataaggc

SEQ ID NO: 170 - DNA, 55 bp, Artificial Sequence
  Synthetic
gagtccgagcagaagaagaagttttagagctagaaatagcaagttaaaataaggc

SEQ ID NO: 171 - DNA, 55 bp, Artificial Sequence
  Synthetic
gagtatgaggcatagactgcgttttagagctagaaatagcaagttaaaataaggc

SEQ ID NO: 172 - DNA, 55 bp, Artificial Sequence
  Synthetic
gatgagataatgatgagtcagttttagagctagaaatagcaagttaaaataaggc

SEQ ID NO: 173 - DNA, 55 bp, Artificial Sequence
  Synthetic
gaagatagagaatagactgcgttttagagctagaaatagcaagttaaaataaggc

SEQ ID NO: 174 - DNA, 55 bp, Artificial Sequence
  Synthetic
gggaataaatcatagaatccgttttagagctagaaatagcaagttaaaataaggc

SEQ ID NO: 175 - DNA, 56 bp, Artificial Sequence
  Synthetic
gttagtccttaaaatgtaggggttttagagctagaaatagcaagttaaaataaggc

SEQ ID NO: 176 - DNA, 56 bp, Artificial Sequence
  Synthetic
gcttgaccaatagccttgacagttttagagctagaaatagcaagttaaaataaggc

SEQ ID NO: 177 - DNA, 56 bp, Artificial Sequence
  Synthetic
gatatttgcattgagatagtggttttagagctagaaatagcaagttaaaataaggc

SEQ ID NO: 178 - DNA, 58 bp, Artificial Sequence
  Synthetic
  misc_feature (34)..(37): n is a, c, g, or t
acactctttccctacacgacgctcttccgatctnnnngcgaacacactgagacagaac

SEQ ID NO: 179 - DNA, 50 bp, Artificial Sequence
  Synthetic
tggagttcagacgtgtgctcttccgatctgcactcctagttaggcttgtg

SEQ ID NO: 180 - DNA, 60 bp, Artificial Sequence
  Synthetic
  misc_feature (34)..(37): n is a, c, g, or t
acactctttccctacacgacgctcttccgatctnnnngtccctggatggatgggctatgg

SEQ ID NO: 181 - DNA, 52 bp, Artificial Sequence
  Synthetic
tggagttcagacgtgtgctcttccgatctggctttcccagacctgagttccc

SEQ ID NO: 182 - DNA, 57 bp, Artificial Sequence
  Synthetic
  misc_feature (34)..(37): n is a, c, g, or t
acactctttccctacacgacgctcttccgatctnnnncctggcctcactggatactc

SEQ ID NO: 183 - DNA, 52 bp, Artificial Sequence
  Synthetic
tggagttcagacgtgtgctcttccgatctctgacaaaagaagtcctggtatc

SEQ ID NO: 184 - DNA, 57 bp, Artificial Sequence
  Synthetic
  misc_feature (34)..(37): n is a, c, g, or t
acactctttccctacacgacgctcttccgatctnnnnccagccccatctgtcaaact

SEQ ID NO: 185 - DNA, 54 bp, Artificial Sequence
  Synthetic
tggagttcagacgtgtgctcttccgatcttgaatggattccttggaaacaatga

SEQ ID NO: 186 - DNA, 57 bp, Artificial Sequence
  Synthetic
  misc_feature (34)..(37): n is a, c, g, or t
acactctttccctacacgacgctcttccgatctnnnnatgtgggctgcctagaaagg

SEQ ID NO: 187 - DNA, 49 bp, Artificial Sequence
  Synthetic
tggagttcagacgtgtgctcttccgatctcccagccaaacttgtcaacc

SEQ ID NO: 188 - DNA, 57 bp, Artificial Sequence
  Synthetic
  misc_feature (34)..(37): n is a, c, g, or t
acactctttccctacacgacgctcttccgatctnnnngaacccaggtagccagagac

SEQ ID NO: 189 - DNA, 49 bp, Artificial Sequence
  Synthetic
tggagttcagacgtgtgctcttccgatcttcctttcaacccgaacggag

SEQ ID NO: 190 - DNA, 57 bp, Artificial Sequence
  Synthetic
  misc_feature (34)..(37): n is a, c, g, or t
acactctttccctacacgacgctcttccgatctnnnnacgtctcatatgccccttgg

SEQ ID NO: 191 - DNA, 51 bp, Artificial Sequence
  Synthetic
tggagttcagacgtgtgctcttccgatctacgtaggaattttggtgggaca

SEQ ID NO: 192 - DNA, 57 bp, Artificial Sequence
  Synthetic
  misc_feature (34)..(37): n is a, c, g, or t
acactctttccctacacgacgctcttccgatctnnnncagctcagcctgagtgttga

SEQ ID NO: 193 - DNA, 48 bp, Artificial Sequence
  Synthetic
tggagttcagacgtgtgctcttccgatctctcgtgggtttgtggttgc

SEQ ID NO: 194 - DNA, 57 bp, Artificial Sequence
  Synthetic
  misc_feature (34)..(37): n is a, c, g, or t
acactctttccctacacgacgctcttccgatctnnnnagagactgattgcgtggagt

SEQ ID NO: 195 - DNA, 49 bp, Artificial Sequence
  Synthetic
tggagttcagacgtgtgctcttccgatctcactccagcctaggcaacaa

SEQ ID NO: 196 - DNA, 57 bp, Artificial Sequence
  Synthetic
  misc_feature (34)..(37): n is a, c, g, or t
acactctttccctacacgacgctcttccgatctnnnngtctgaggtcacacagtggg

SEQ ID NO: 197 - DNA, 49 bp, Artificial Sequence
  Synthetic
tggagttcagacgtgtgctcttccgatctctgagagcagggaccacatc

SEQ ID NO: 198 - DNA, 57 bp, Artificial Sequence
  Synthetic
  misc_feature (34)..(37): n is a, c, g, or t
acactctttccctacacgacgctcttccgatctnnnntcacttcagcccaggagtat

SEQ ID NO: 199 - DNA, 49 bp, Artificial Sequence
  Synthetic
tggagttcagacgtgtgctcttccgatcttctctttctctcccccaccc

SEQ ID NO: 200 - DNA, 57 bp, Artificial Sequence
  Synthetic
  misc_feature (34)..(37): n is a, c, g, or t
acactctttccctacacgacgctcttccgatctnnnngggaggtggagagaggatgt

SEQ ID NO: 201 - DNA, 49 bp, Artificial Sequence
  Synthetic
tggagttcagacgtgtgctcttccgatcttcctgaggtctaggaacccg

SEQ ID NO: 202 - protein, 1625 aa, Artificial Sequence
  Synthetic
MKRTADGSEFESPKKKRKVSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSGGSGGSTNLSDIIEKETGKQLVIQESILMLPEEVEEVIGNKPESDILVHTAYDESTDENVMLLTSDAPEYKPWALVIQDSNGENKIKMLSGGSGGSGGSTNLSDIIEKETGKQLVIQESILMLPEEVEEVIGNKPESDILVHTAYDESTDENVMLLTSDAPEYKPWALVIQDSNGENKIKMLSGGSKRTADGSEFEPKKKRKV

SEQ ID NO: 203 - protein, 228 aa, Rattus rattus; identical to SEQ ID NO: 4

SEQ ID NO: 204 - protein, 228 aa, Artificial Sequence; identical to SEQ ID NO: 5
  Synthetic

SEQ ID NO: 205 - protein, 228 aa, Artificial Sequence; identical to SEQ ID NO: 6
  Synthetic

SEQ ID NO: 206 - protein, 228 aa, Artificial Sequence; identical to SEQ ID NO: 7
  Synthetic

SEQ ID NO: 207 - protein, 228 aa, Artificial Sequence; identical to SEQ ID NO: 8
  Synthetic

SEQ ID NO: 208 - protein, 228 aa, Artificial Sequence; identical to SEQ ID NO: 9
  Synthetic

SEQ ID NO: 209 - protein, 272 aa, Artificial Sequence
  Synthetic
GSGATNFSLLKQAGDVEENPGPMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYKSGGSPKKKRKV

SEQ ID NO: 210 - protein, 1800 aa, Artificial Sequence; identical to SEQ ID NO: 24
  Synthetic

SEQ ID NO: 211 - DNA, 4875 bp, Artificial Sequence
  Synthetic
atgaaacggacagccgacggaagcgagttcgagtcaccaaagaagaagcggaaagtctctggaggatctagcggaggatcctctggcagcgagacaccaggaacaagcgagtcagcaacaccagagagcagtggcggcagcagcggcggcagcgacaagaagtacagcatcggcctggacatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgacagcggcgggagcggcgggagcggggggagcactaatctgagcgacatcattgagaaggagactgggaaacagctggtcattcaggagtccatcctgatgctgcctgaggaggtggaggaagtgatcggcaacaagccagagtctgacatcctggtgcacaccgcctacgacgagtccacagatgagaatgtgatgctgctgacctctgacgcccccgagtataagccttgggccctggtcatccaggattctaacggcgagaataagatcaagatgctgagcggaggatccggaggatctggaggcagcaccaacctgtctgacatcatcgagaaggagacaggcaagcagctggtcatccaggagagcatcctgatgctgcccgaagaagtcgaagaagtgatcggaaacaagcctgagagcgatatcctggtccataccgcctacgacgagagtaccgacgaaaatgtgatgctgctgacatccgacgccccagagtataagccctgggctctggtcatccaggattccaacggagagaacaaaatcaaaatgctgtctggcggctcaaaaagaaccgccgacggcagcgaattcgagcccaagaagaagaggaaagtc

SEQ ID NO: 212 - DNA, 684 bp, Rattus rattus; identical to SEQ ID NO: 37

SEQ ID NO: 213 - DNA, 686 bp, Artificial Sequence
  Synthetic
agcagtgaaaccggaccagtggcagtggacccaaccctgaggagacggattgagccccatgaatttgaagtgttctttgacccaagggagctgaggaaggagacatgcctgctgtacgagatcaagtggggcacaagccacaagatctggcgccacagctccaagaacaccacaaagcacgtggaagtgaatttcatcgagaagtttacctccgagcggcacttctgcccctctaccagctgttccatcacatggtttctgtcttggagcccttgcggcgagtgttccaaggccatcaccgagttcctgtctcagcaccctaacgtgaccctggtcatctacgtggcccggctgtatcaccacatggaccagcagaacaggcagggcctgcgcgatctggtgaattctggcgtgaccatccagatcatgacagccccagagtacgactattgctggcggaacttcgtgaattatccacctggcaaggaggcacactggccaagatacccacccctgtggatgaagctgtatgcactggagctgcacgcaggaatcctgggcctgcctccatgtctgaatatcctgcggagaaagcagccccagctgacatttttcaccattgctctgcagtcttgtcactatcagcggctgcctcctcatattctgtgggctacaggcctttgaaa

SEQ ID NO: 214 - DNA, 686 bp, Artificial Sequence
  Synthetic
tcatcagaaacaggaccagtcgccgtggacccaacactgaggagaaggattgagccccatgaatttgaagtctttttcgaccccagggagctgaggaaggaggcatgcctgctgtacgagatcaagtggggcacaagccacaagatctggcgcaacagcggcaagaacaccacaaagcacgtggaagtgaatttcatcgagaagtttacctccgagcggcacttctgcccctctatcagctgttccatcacatggtttctgtcttggagcccttgctgggagtgttccaaggccatccgcgagttcctgtctcagcaccctaacgtgaccctggtcatctacgtggcccggctgtttcaacacatggaccagcagaacaggcagggcctgcgcgatctggtgaattctggcgtgaccatccagatcatgacagcctcagagtacgaccattgctggcggaacttcgtgaattatccacctggcaaggaggcacactggccaagatacccacccctgtggatgaagctgtatgcactggagctgcacgcaggaatcctgggcctgcctccatgtctgaatatcctgcggagaaagcagccccagctgacatttttcactatcgcactgcagagctgtcattaccagagactgcctcctcatatcctgtgggctacaggcctttgaaa

SEQ ID NO: 215 - DNA, 686 bp, Artificial Sequence
  Synthetic
agcagcgagacaggacccgtggcagtggaccctacactgaggaggaggattgagcccgaatttttcaacaggaactacgaccccagagagctgcggaaggagacatacctgctgtatgagatcaagtggggcaaggagtccaagatctggcggcacacctctaacaatagaacacagcacgccgaggtgaacttcctggagaacttctttaatgagctgtactttaatccttctacccactgcagcatcacatggttcctgagctggtccccatgcggcgagtgttctaaggccatcgtggagtttctgaaggagcaccccaacgtgaatctggagatctacgtggccaggctgtatctgtgcgaggacgagaggaacaggcagggcctgcgggatctggtgaatagcggcgtgaccatcagaatcatgaacctgcctgactacaattattgttggcgcacattcgtgtcccaccagggaggcgacgaggattattggccaaggcactttgcaccatgggtgcgcctgtacgtgctggagctgtattgcatcatcctgggcctgcccccttgtctgaacatcctgcggagaaagcagccccagctgacattcttcaccatcgcactgcagagttgtcattaccagcgactgcctcctcatatcctgtgggctacaggcctttgaaa

SEQ ID NO: 216 - DNA, 686 bp, Artificial Sequence
  Synthetic
tcatcagagaccggacctgtggcagtggacccaaccctgcgacggagaatcgagcccttttactttcagttcaacaacgacccaagagcctgccggagaaagacctacctgtgctatgagctgaagcaggacggctctacctgggtgtggaagcggacactgcacaacaagggcagacacgccgagatctgcttcctggagaagatcagctccctggagaagctggaccctgcccagcactacaggatcacatggtatatgtcttggagcccatgctccaactgtgcccagaagatcgtggattttctgaaggagcacccacacgtgaatctgcggatctacgtggccagactgtactatcacgaggaggagaggtatcaggagggcctgaggaacctgaggcgctccggcgtgtctatcagagtgatggacctgcccgatttcgagcactgctgggagacattcgtggataacggaggaggacctttccagccatggcccggcctggaggagctgaatagcaagcagctgtcccggagactgcaggcaggaatcctgggcctgcccccttgtctgaatatcctgaggcgcaagcagccccagctgacatttttcaccatcgcactgcagagttgtcattatcagcgactgcctcctcatatcctgtgggctacaggcctttgaaa

SEQ ID NO: 217 - DNA, 686 bp, Artificial Sequence
  Synthetic
agcagcgagaccggacctgtggcagtggacccaaccctgagaagacgcattgagccatttcattttcagtttaacaacgaccccagagcctaccggagaaagacctacctgtgctatgagctgaagcaggacggctccacctgggtgctggatcggacactgagaaacaagggccggcacgccgagatctgtttcctggacaagatcaattcctgggagaggctggatcccgcccagcactaccgcgtgacatggtatatgagctggtccccttgctctaactgtgcccagcaggtggtggatttcctgaaggagcacccacacgtgaatctgcggatctttgccgccagactgtactatcacgagcagaggcgctatcaggagggcctgcggagcctgaggggaagcggagtgcctgtggccgtgatgaccctgccagacttcgagcactgctgggagacatttgtggatcacggcggccggccattccagccatgggacggcctggaggagctgaactctaggagcctgtcccggagactgcaggcaggaatcctgggcctgcccccttgtctgaatatcctgaggcgcaagcagccccagctgaccttttttaccatcgcactgcagagttgtcactaccagagactgcctcctcatatcctgtgggctacaggcctttgaaa

SEQ ID NO: 218 - DNA, 852 bp, Artificial Sequence
  Synthetic
tctggtggttctcccaagaagaagaggaaagtcggaagcggagctactaacttcagcctgctgaagcaggctggagacgtggaggagaaccctggacctatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtctggtggttctcccaagaagaagaggaaagtctaa

SEQ ID NO: 219 - DNA, 5409 bp, Artificial Sequence; identical to SEQ ID NO: 48
  Synthetic

SEQ ID NO: 220 - protein, 166 aa, Artificial Sequence
  Synthetic
LGKEFCGAFYHPRSKSKQSCAIAKRGHDATLTRRYTNSKKHAEEFFLMDIDCQARHFWNKKWQITMYLTMQPCHSTDTGGTKEDQSCCEVMIKAKEKLGNVEIVIKPTHLCQVGKGKPEKGVRKLKTTGIELECMKEGDWKYYAQPEENPYDTSKTEELHNQQLEQ

SEQ ID NO: 221 - protein, 155 aa, Artificial Sequence
  Synthetic
CMATGTKCVGAKAQSPEGFVVNDCHAEVLCRRSFIHYLIKEIQKVFEPCEGDFHLQVKRDYHFYMYISQSPCGYGSEYETNGKAMEQSCSDKLCLLISPIYLTGIVICWDEARMKNALADRIEVSAIVWSFFKEVVQYKEIKRERYEQAKESLMK

SEQ ID NO: 222 - protein, 151 aa, Artificial Sequence
  Synthetic
SLGTGSKCIGEHKMSLEGWLVNDSHAEIIARRGFVKYLIGQLKSIFERSPIKGQYSIKNGGDASIFLSTKHSSCSDKMMRLIDKPVYLHSITVELYNQEAMERALVGRLCLSKELLGSIVWSDFKELVQNDLPVYYDWKQSSYQKARTLFN

SEQ ID NO: 223 - protein, 166 aa, Artificial Sequence
  Synthetic
SMGTGSKCVGQNKLSKDGDILNDSHAEVVARRGFLRYMYHQMEILFTVDAISKKFLQREGVSFIFFSSHTPCGDASIIVKENSMCNSCSDKLAKFLSKPIYVSHVIICPYSQSVMERALINRFEHSANQLSSISWQKFVSLLSDNLPIYNKAKRLCYFEMWEQTRA

SEQ ID NO: 224 - protein, 156 aa, Artificial Sequence
  Synthetic
SLCTGTKCLSGVELRSTGNKLSDSHAEILARRAFLRYLYHQIELIFYLEDNGIKLRDVSFHFFSSQTPCGDCSIIKLTGEDLSCSDKLAKLMIPTIKFESIVICPYSLESMQRGIFQRFDPSSIVWKTFLTIYDPQHPKYYHCKQYSYQNLWREKS

SEQ ID NO: 225 - protein, 157 aa, Artificial Sequence
  Synthetic
ALATGTKCLGDSELSKGGSRLSDSHAEVLTRRAFIRYLYDQIDLIFSRNDKNKIELNSNISFHFFSSQTPCGDCSIFKLETNSCSDKIAKLLIPPIKLESITISPFSLDAMERGLYKRFNNISIIWQSFLQIFDIRHPKYYDWKQWSYQNEWKQLKH

SEQ ID NO: 226 - protein, 159 aa, Artificial Sequence
  Synthetic
ALATGTKCLGDSELSESGSRLSDSHAEVLTRRAFIRYLYDQIDLIFSRNDDNEIELNNNISFHFFSSQTPCGDCSIFKEETTSDSCSDKMAKLMIPPIKLESITICPFSLDAMERGLYKRFNNISIVWRSFLQIFDIRHPKYYDWKQWSYQNEWKRLRR

SEQ ID NO: 227 - protein, 157 aa, Artificial Sequence
  Synthetic
ALATGTKCLGESELINDGSRLSDSHAEVLARRAFIRYLYDQIDLVFSWSHKNKIELNSNVSFHFFSSQTPCGDCSIFKHEIYSCSDKMAKLLIPPIKLKSITICPFSLDAMERGLYKRFNNTSIIWQTFLQIFDIRHPKYYDWKQWSYQSKWKQLKL

SEQ ID NO: 228 - protein, 158 aa, Artificial Sequence
  Synthetic
ALATGTKCLGESELTNSGSRLSDSHAEVLTRRAFIRYLYDQIDLVFKRNDKNKIELNSAISFHFFSSQTPCGDCSIFKEKTSNSCSDKIAKLMIPSIRLESITICPFSFDAMERGLYKRFNNSSIIWQTFLQVLDIKHPKYYDWKQWSYQNKWRQLQF

SEQ ID NO: 229 - protein, 163 aa, Artificial Sequence
  Synthetic
SLGTGTKCLGADQLSEKGDILNDSHAEVMARRGFLRFVMQQMTSIFEFNSESRKFSCKSGISFHFFTTHSPCGDASIYETSRSSCSDKMARLLERPIYLESVVITDFCKEAIERALWKRWDPDVVEGGGIVWATFAAVWKGADMDYVDVKNRSYREQWDALRV

SEQ ID NO: 230 - protein, 163 aa, Artificial Sequence
  Synthetic
SLGCGTKCIGQDKQCPKGYILNDSHAEIIARRAFLRYLYHELNKIFEWDHELVCYKLKKHYEYHFLCTHTPCGDACIGQLDTEVSCSDKLARLIHEPIYFTSFNFSEANVADIERAIFKRWQHKEFRNGLSWLCFLELLRIRKSLYGTCKQLAYQEAWQQLKS

SEQ ID NO: 231 - protein, 164 aa, Artificial Sequence
  Synthetic
SLATGTRCIGSSKLCARGFILNDCHAEVLARRGFLRYLNNEIMKIFSWQTAERCFTLNENLVFHFLSTQTPCGDACILESNIDTLSCSDKLSRLLNKPIYFTSFNFADAHLKSLQRALYQRWNGRSCKNSLIWLNFLNLLNLRQKLYAQCKALAYQLVWQQLKC

SEQ ID NO: 232 - protein, 162 aa, Artificial Sequence
  Synthetic
ALATGTRCIGASKLCAKGFVINDSHAEVLARRAFLRYLHNQLLKIFSWKSAAGCFTLNEQLEYHFLSTQTPCGDACIVDSEILSCSDKLSRLIDKPIYFSSLNFAEARLESLQRAVYQRWRGRNCSTSLIWLNFLDLLHLREKFYAECKALAYQLAWRQLKC

SEQ ID NO: 233 - protein, 163 aa, Artificial Sequence
  Synthetic
ALATGTRCIGASKLCNRGYILNDCHAEVLARRAFLRYLQNELLNVFIWKPSTGCFALNEQLEYHFLSTQTPCGDACIVDDACGVSCSDKLARVIDKPIYFISYNFTEANPESLERAIYRRWQGRECNSSLIWINFMDLLSVREKLYSELKALSYQLAWQQLKS

SEQ ID NO: 234 - protein, 164 aa, Artificial Sequence
  Synthetic
ALGCGTKCIGYTRHCPKGFILNDSHAEVLARRAFLRYLYHELEHIFQWAAKRGSFDLSAHVEYHFFSTQTPCGDACIVESVVVESCSDKLARLLSKPIYFSTLNFTEARQESVERAIYKRWQQGRDSKNGLVWLKFLNILHLREKFYASCKDLCYQQAWCQLKR

SEQ ID NO: 235 - protein, 161 aa, Artificial Sequence
  Synthetic
ALGLGTKCIPHTKLCENGFILNDSHAEVLARRAFQRYLYHELGQIFHWNCDSQCYDLDDHVEYHFLSTQTPCGDACIVEEDRSCSDKLSRLISKPIYFSTLNFADAHFESLNRAIYKRWEGRNFSNGLVWLTFLDCISLSEKFYATCKSWSYQEAWLQLKD

SEQ ID NO: 236 - protein, 161 aa, Artificial Sequence
  Synthetic
SLGCGTKCIGESKLCPKGLILNDSHAEVLARRGFLRFLYQELKQIFHWNSELSTFDMDEHVEFHFLSTQTPCGDACILEEQVSCSDKIARLISKPIYFSSLNFDDAQLESLERAIFKRFECRSFKNGLIWLTFLELVKLSEKFYASCKNLAYQFAWREIKE

SEQ ID NO: 237 - protein, 164 aa, Artificial Sequence
  Synthetic
AIGSGTTCLGESQMRPDGLILHDSHAEVIARRSFIRYLYHEIKSIFNKLIDGKCCLKPGISFHFYTSNTPCGDATIFVTVNQPVNTSCSDKILRLVSTPVYMRSIVVADIQALRRAFYGRMDLNSLDFSALSWRMFKEVMECELKSYRNCKLLAYFNTWSDVKD

SEQ ID NO: 238 - protein, 166 aa, Artificial Sequence
  Synthetic
AMGTGSKCIGRSKMRLEGDVLHDSHAEIIARRAFLRYLYHQLQMVFTTPGADCRCGLKPGVKFHLFTSHTPCGDASIFKGSKSTIDQSCSDKLARFMTEPVYFSTIVVCPYSSYAMYRGIVDRCAGIQDLAAIMWETFKQLLNERRPAYGDYKRAAHHTAKTCFLR

SEQ ID NO: 239 - protein, 166 aa, Artificial Sequence
  Synthetic
SLGTGTKCIGRSAMSMKGDVLNDSHAEVIARRGSVRYLTEQLLKVFCAGSEKGKWRLKAGVSFLFFTSQTPCGDASIFMSGSEPCETSCSDKLARYLQEALYFSAVLVSPYSHPALRRALHTRCSHVKDLAAISWHSFLKVVAAELPEYWDYKQAAYQLAWTQLRL

SEQ ID NO: 240 - protein, 166 aa, Artificial Sequence
  Synthetic
SLATGTKCIGRTALSPNGDVLNDSHAEVIARRGCVRYLIQELHRVFCRAEQQGKWKLKPGVSFHFFTSHTPCGDASIIMSDSQPCPGSCSDKMARYLQEALYFTSVVVCPYSQEVMHRALVARCLHVSDLAAISWHSFLSLVSSSLPSYWDYKRASYQQAWQQLHS

SEQ ID NO: 241 - protein, 166 aa, Artificial Sequence
  Synthetic
AMGTGTKCIGQAKLRKTGDVLQDSHAEIIAKRSFQRYLLHQLSLLFIPGTEKGKWMLRPEISFVFFTSHTPCGDASIIVISHELGHGSCSDKMARFLQQPIYLSAVVVCPFSQDAMERALYNRCHKVLSLAAVSWNTFRELVQKQRSEYWDYKAAAYQEAWNCLRQ

SEQ ID NO: 242 - protein, 166 aa, Artificial Sequence
  Synthetic
AMGTGTKCIGRNKMRKTGDILNDSHAEVVAKRSFQRYLLHQLWLIFSPGTETGKWKLKPNIIFIFFSSHTPCGDASIFISEPELSKNSCSDKLARFLQYPVYLSAVIVCPYSQEAMRRAVIERCQHVSSLAAISWHKFQRLMTEDLPDYWDYKQAAYQEAWRVLRS

SEQ ID NO: 243 - protein, 166 aa, Artificial Sequence
  Synthetic
ALGTGTKCIGLNKMRKTGDVLNDSHAEVVAKRSFQRYLLHQMRLIFIPGTETGKWKLKPNIIFIFFCSHTPCGDASIIIRETELSKSSCSDKLARFLQYPVYLSAVIVCPYSQEAMQRAVIERCRHISLLAAISWHEFQKLVTENLPDYWDYKEAAYQEAWKALRS

SEQ ID NO: 244 - protein, 166 aa, Artificial Sequence
  Synthetic
AMGTGTKCIGQNKMRKTGDILNDSHAETVAKRSFQRYLLHQMCLIFIPGTETGKWKLKPNIIFVFFSSHTPCGDASIIISEPELSKNSCSDKLARFLQYPVYLSAIIVCPYSQEAMRRAIIERCQHVSFLAAISWHAFQKLVTENLPDYWDYKEAAYQEAWKVLRS

SEQ ID NO: 245 - protein, 166 aa, Artificial Sequence
  Synthetic
AMGTGTKCIGQSKMRKDGDILNDSHAEVIAKRSFQRYLLHQIEAIFIPGTEVGKWKLKPDLSFVFFSSHTPCGDASIIMLDVEPCPRSCSDKLARLLQDPVYLAAVVICPYSPEAVRRAVIDRCRHVSPLAAISWGAFQKLVGDKQPAYWDYKEAAYQETWKALQR

SEQ ID NO: 246 - protein, 166 aa, Artificial Sequence
  Synthetic
SMGTGTKCIGLSKMRKNGDILNDSHAEVIAKRSFQRYLLHQLRSIFMPGTKTGMWKLKPDLHFVFFSSHTPCGDASIIMLELEPCSHSCSDKLARFLEEPVYLAALVICPYSPEAMKRAVIDRCQHVSSLAAISWNLFQNLVSSKRPEYWEYKEAAYQEAWKTLQK

SEQ ID NO: 247 - protein, 166 aa, Artificial Sequence
  Synthetic
SMGTGTKCIGQSKMRKSGDILNDSHAEIIAKRSFQRYLLYQLHMIFVPGTQRGLWKLRPDLSFVFFSSHTPCGDASIIMLEFEPCCSSCSDKVARFLEEPIYLSAVVICPYSQEAMQRALLGRCQNVSALAAISWRSFQKLLSDKWPDYQEHKEAAYQEAWRTLRK

SEQ ID NO: 248 - protein, 165 aa, Artificial Sequence
  Synthetic
SMGTGTKCIGQSKMRKSGEVLNDSHAEVIARRSFQRYLLHQPHLIFIPGTQRGLWKLRPDVFLFVSSHTPCGDASIIMLEFEPCYSSCSDKLARFLEEPVYLSAVVICPYSQEAMQRAPVRRCRMSPLYAAISWRSFQELLSDKWPDYQEYEEASYQEAWSALRK

SEQ ID NO: 249 - protein, 166 aa, Artificial Sequence
  Synthetic
SMGTGTKCIGQSKMRKSGDILNDSHAEIIARRSFQRYLLHQLHLIFVPGTRRGLWKLRPDLLFVFFSSHTPCGDASIIMLEFEPCCSSCSDKLARFLEEPIYLSAVVICPYSQEAMQRALTGRCHNISALAAISWRSFQKLLSDKWPDYQEYKEAAYQEAWSALRK

SEQ ID NO: 250 - protein, 166 aa, Artificial Sequence
  Synthetic
SMGTGTKCIGQSKMRKSGDILNDSHAEVIARRSFQRYLLHQLHLIFVPGTQRGLWKLRPDLSFVFFSSHTPCGDASIIMLEFEPCCSSCSDKLARLLEEPVYLSAVVICPYSQEAMHRALTGRCQNVSALAAISWRSFQKLLSDKWPDYHEYKEAAYQEAWSALRK

SEQ ID NO: 251 - protein, 166 aa, Artificial Sequence
  Synthetic
SMGTGTKCIGQSKMRESGDILNDSHAEIIARRSFQRYLLHQLHLIFVPGTQRGLWRLRPDLSFVFFSSHTPCGDASIIMLEFEPCCSSCSDKMARFLEKPIYLSAVVICPYSQEAMRRALTGRCEETLVLAAISWRSFQKLLSDEQPDYQEYKDAAYQEAWGALRR

SEQ ID NO: 252 - protein, 166 aa, Artificial Sequence
  Synthetic
SMGTGTKCIGQSKMRKSGDVLNDSHAEVIARRSFQRYLCHQLQLIFVLGTQKGQWKLRPGISFVFFSSHTPCGDASIIMLGFEPCYSSCSDKVARFLEEPIYLSAVVICPYSQEAMHRALIGRCQNISALAAISWRSFQKLLSDMWPNYQEYKQAAYQEAWSALRK

SEQ ID NO: 253 - protein, 166 aa, Artificial Sequence
  Synthetic
SMGTGTKCIGQSKMRKSGDILNDSHAEVIARRSFQRYLLHQLQLIFVPGTQKGLWKLRRDLFFVFFSSHTPCGDASIIMLEFEPCCSSCSDKMARFLEEPIYLSAVVICPYSQEAMQRALTGRCQNVSALAAISWRSFQKLLSDKWPDYQDYKEAAYQEAWSTLRK

SEQ ID NO: 254 - protein, 166 aa, Artificial Sequence
  Synthetic
SMGTGTKCIGQSKMRKSGDILNDSHAEVIARRSFQRYLLYQLQLIFVPGTQRGLWKLRPNLLFVFFSSHTPCGDASIIMLEFEPCCGSCSDKMARFLEEPIYLSAVVICPYSQEVMQRALIGRCQNVLALSAISWRSFQKLLSDKWPDYQEHKEAAYQEAWSALRK

SEQ ID NO: 255 - protein, 152 aa, Artificial Sequence
  Synthetic
ALGTGTKCLGGSQRSLAGDTINDCHAEVIARRTLLKLLYTDIGSNGRLRMRPEIRLHLYISQSPCGDACGVDSCSDKIARFLNEPVYISTITVSDLACIEALQRATFGRLCSVARNYSISWRSFRHLLTHFFPGYLECKKLAYLEAKEILLH

SEQ ID NO: 256 - protein, 160 aa, Artificial Sequence
  Synthetic
ALGTGTKCIGGSLLSPTGDVVNDSHAEIIARRSLLRYFYAEIERAFDTSCCGQTKYRMNPGWGLHLYITQLPCGVFSYPTLRELSCFNKITRILQPVYLSTLTVSVKTNYLEKAIYDCMERLHIKYSICWEVFVSLQSRLSLQYHGLKAMAYQSSLKMLR

SEQ ID NO: 257 - protein, 163 aa, Artificial Sequence
  Synthetic
SLGTGTKCIGRSRRSSKGDVVNDSHAEIIARRALLRYLYSEIQDMFESDGLGTKKLKMKHGWQLHLYISQLPCGVASPGSELAHDSMSCSDKIARFLEPIYIFSVTISIIEDEVMRAIHERVLPLSNKYSICWESFLSLSHNCVGEYRELKDKSYNLASETFK

SEQ ID NO: 258 - protein, 158 aa, Artificial Sequence
  Synthetic
AMGTGTKCLGRSLLRTCGDVVHDSHAEVIARRALIRFFYTQIQPFDPGCLNKGKYSLKKDWKLHMYISQLPCGDASLSVSPLSCSDKIARFLQPVYLSSITVFRLEDSLKRALYERMLPLSNEYSICWEVFLSLGPENLIGYRELKDGAYHLASKIFK

SEQ ID NO: 259 - protein, 162 aa, Artificial Sequence
  Synthetic
ALGTGTKCVSGSLLSPRGDIVNDSHAEVVARRALIRFFYSEIQRSIDSSCPGEVKYKLKSGCLLHLYISQLPCGYASTSSPLYKKISCSDKIARVLQPVYISTITVFSLADHLRRSLYERILPLSDEYSLCWELFLKETHGHKREYRELKNKAYYLMSKIFK

SEQ ID NO: 260 - protein, 164 aa, Artificial Sequence
  Synthetic
SLGTGNRCVTGDKLSMEGRTVNDSHAEIITRRAFLRYLYNQLQAILTQGTNGKLRLLPDVSLHLYISTAPCGDGAQFSRTDENESSCSDKVASFIEPMYLSSISLSLYHHGHLARAVCCRVSSELDNLLSINWSEYQQTCRLFDRTYHDAKLSAYYTAKQYLKC

SEQ ID NO: 261 - protein, 163 aa, Artificial Sequence
  Synthetic
SFGTGTRTASGDLLDLKGEVVFDSHAEIIARRGLKMFLYQELQVIFEANEDGKLRVKKSIKFHLYISTAPCGDGAQFSRLDNRLSSCSDKIGSFVEPVYLFSLSLSLHHHGHLSRAVCCRFHELGPYLSMNWNEFLSLSSVSGHTYAEAKSLAYQEAKGLLHK

SEQ ID NO: 262 - protein, 163 aa, Artificial Sequence
  Synthetic
SLGAGNRCVTGQRLSMEGKVVNDSHAEIIARRSLLRFFYAQLHAIFEKNNSRRLAVRQGVSFHLYISTAPCGDGALFTPRENTDLSCSDKICRFIEPVYLESLTLYLYDHGHLARAVCCRLQDLGAELSVNWESFKELCQRTDREYSQAKQMAFQNAKRELFE

SEQ ID NO: 263 - protein, 164 aa, Artificial Sequence
  Synthetic
SIGTGNRCITGPQLSLEGNTVNDSHAEIITRRGFIRFMYKQLQALFEPSPSGKLRLKDNITFHLYISTAPCGDGALFSPRDSNNASCTDKLCRLMDPVYLDSLTLLLYDHGHLARAMCCRLARDINSLLSVNWDNFKQVCADLGKQYGKAKTAAFQTAKKALIK

SEQ ID NO: 264 - protein, 163 aa, Artificial Sequence
  Synthetic
SMGTGNRCISGERLSQEGLVVNDSHAEIVTRRGFLRFLYKQLIEIFEPSENRKFRVKPDVTFHLYISTAPCGDGALFSKTDVSELSCSDKIARFVDPIYLTSITLYLYDHGHLSRAVCCRLSELDTLHSLSWASFKEACIKHQRDYYLVKTAAFQKAKKVLLE

SEQ ID NO: 265 - protein, 161 aa, Artificial Sequence
  Synthetic
SLGTGNRCVKGEELSLKGETVNDCHAEIISRRGFIRFLYSELLKIFEPAEENKLKIKPDITFHLYISTAPCGDGALFDCSEKSCSDKILRFLHPIYLKSITLYLYSHGHLTRAVCCRLARAFSQNSSVNWCLFRSLCQRCGRTYAQAKTSAFQLAKQQFFE

SEQ ID NO: 266 - protein, 161 aa, Artificial Sequence
  Synthetic
SIGTGNRCVKGEELSLKGETVNDCHAEIISRRGFIRFLYSELMKFLEVVSDGRMKIKTGVTFHLYISTAPCGDGALFDCSEKSCSDKILRFLHPVYLSSVTLYLYSQGHLARAICCRMSRAFQEGSSVNWQLFQQICTKTDRKYQEAKEAAFQKAKVHFVQ

SEQ ID NO: 267 - protein, 161 aa, Artificial Sequence
  Synthetic
SIGTGNRCVKGEELSLKGETVNDCHAEIISRRGFVRFLYSELMKIFEPAGKKRLKIKSNVTFHLYVSTAPCGDGALFDCSDKSCSDKILRFIEPVYLSSVTLYLYSQGHLTRAICCRMVRVLQKRSSVNWALFQQLCAKNKRKYSEAKEAAYQEAKQRFFS

SEQ ID NO: 268 - protein, 162 aa, Artificial Sequence
  Synthetic
  misc_feature (40)..(40): Xaa can be any naturally occurring amino acid
SIGTGNRCVKGEELSLRGETVNDCHAEIVSRRGFISNTIXSQLMKIFEEAEGDLLRVRPGVTFHLYISTAPCGDGALFDCSDKSCSDKILRFMEPVYLSSLTLYLFSQGHLTRAICCRMSRAFQNQSSVNWTLFQQLSVLRGRHYSDVKATAYQTAKGQLFR

SEQ ID NO: 269 - protein, 162 aa, Artificial Sequence
  Synthetic
SLGTGNRCVKGDSLSLKGETVNDCHAEIISRRGFIRFLYSELMKIFEPAKGGEKLQIKKTVSFHLYISTAPCGDGALFDCSDKSCSDKILRFLQPIYLKSVTLYLFSQGHLTRAICCRVTRAFEDGTSVNWLLFKKLCSFRYRRYGEAKKAAYETAKNYFKK

SEQ ID NO: 270 - protein, 164 aa, Artificial Sequence
  Synthetic
AMGTGNSCVMGKNIGTDGRTLNDCHAEVVVRRSLLRYLYRELKNIFEKHSDSLLVLKEGVSFHLYLTTAPCGDAATHITRDTRVQSCSDKLAKFIEPVYLSSVTFTNYDHGQLSRALCCRIDDHISADISLNWMRFKAMCTLARRQYNQAKMMCYQEAKRQLYD

SEQ ID NO: 271 - protein, 163 aa, Artificial Sequence
  Synthetic
ALGTGNSCYAGWLAFDGRLLHDCHALVVVRRTLQRFLYKQLLLIFCSSPGGSLSLRPGIFFHLYLGKVPEGAARTTFMYAPRNPSESDKMTRFIQPIYITSVVLHFYDRNTVSQVINKRLEGALIRKSSLNWSSFRKVAEKTGRSYHSVKLRAYQKVKKQVNC

SEQ ID NO: 272 - protein, 162 aa, Artificial Sequence
  Synthetic
ALGTGDICYEGWMEFNGRRVHDMHGMVVARRVLLRYFYKQLLMIFCPAGDGILALKPKYFLHLYLSRTPSGASENFHLAPVVQSGSDKLTRIILPVYITSVVLPYQDHTVLHEVVNDRVQLGPGNGLSLNWSMFRKVVQEMKREYHKGKVQAYQSAKLQMYT

SEQ ID NO: 273 - protein, 158 aa, Artificial Sequence
  Synthetic
ALGTGSSSCAGWLEFSGRQLHDCHGLVVARRALLRFLYRQLLLVLTPQPGPGFVLKPRIFIHFYISNTPKGAAHDIYPPAASASDKLSRFLPPLYATSLVLPCHDPPTLSSAIHTRLDRVSGSCLSLNWRAFRQAAQALGKSYEEAKAYQEARQQLSL

SEQ ID NO: 274 - protein, 158 aa, Artificial Sequence
  Synthetic
ALGTGSSSCAGWLEFSGRRLHDCHGLVIARRALLRFFFRQLLLVLTPQPGSGFALKPGVFLHLYVSNTPKGAAHDIYLASPSASDKLARFLPPLYATSLVLPCHDPPTLNRAIHSRLDSVLGSCLSLNWAAFRQVARALEKPYEAAKAYREARQQLSL

SEQ ID NO: 275 - protein, 158 aa, Artificial Sequence
  Synthetic
ALGTGNSCCAGWLEFSGRQLHDCHALVVARRALLRFLYRQLLLVLAPQPGPGFALKPRIFLHLYVSNTPKGAAHDIYSASTSASDKLARFLPPLYSTSLVLPCHDPSTLSRAIHSRLDGALGPVLSLNWRAFRQAAGALGKPYEAAKAYQEARRRLSL

SEQ ID NO: 276 - protein, 158 aa, Artificial Sequence
  Synthetic
ALGTGSSCCAGWLEFSGQQLHDCHGLVIARRALLRFLFRQLLLVLAPQPGPGFTLKPRVFLHLYISNTPKGAARDIYPTSPSASDKLARLVSPLYSTSLILSCHDPPTLSRAIHTRLDSVLGPCLSLNWRAFHQVARAVGKPYEAAKAYQEARRQLSL

SEQ ID NO: 277 - protein, 164 aa, Artificial Sequence
  Synthetic
ALGTGDFNYSQCICRDGRVVHDSHGVVMARRSLLRFLYRQLLLIFCIEPTSKLTIKPNANIHLYLNQLPKGAAQIKSQLRPQSQSASDKLTRFIQPVYISSVLIANCTDTRGLEIAVKQRVDDALTSRLSLNWSRFNLLAKESNREYHDAKIMSYQEAQCLLKS

SEQ ID NO: 278 - protein, 163 aa, Artificial Sequence
  Synthetic
AIGTGEYNYSQDIKPNGRVLHDTHAVVTARRSLLRYFYRQLLLIFCTEPTSNLTLKQNINICLYMNQLPKGSAQIKSQLRPHSESSSDKLTRFIQPVYISSILVGNCSDTRGLEIAIKQRVDDALTSKLSLNWSRFNLLAKEAKKYHAAKCMSYQEAKCKLKS

SEQ ID NO: 279 - protein, 165 aa, Artificial Sequence
  Synthetic
AVGTGEYNCSQCIKPNGRVLHDTHGVVTARRSLLRYFYRQLLLIFCTEPASDLTLKQDINIYLYMNQLPKGSAQIKSQLRPNSESSSDKLTRFIQPVYISNILVVGNCSDTRGLEIAIKQRVDDALTSRLSMNWSRFNLLAKEAKRDYHAAKCMSYQEAKTLLKS

SEQ ID NO: 280 - protein, 164 aa, Artificial Sequence
  Synthetic
ALGTGDCNYSNDYSPEGRVVHDSHAIVTARRSLLRYFYRHLLLLFCTAPDSKLTLKRNISIYLYMSQLPKGSAQIKTQFCPHSESASDKLTKFIEPVYINTILVGNCRSLKGLEIAIRQRIDDALTSKLSLNWSRFKCLAGRAKRTYHEAKVKSYQEAKKLLHS

SEQ ID NO: 281 - protein, 164 aa, Artificial Sequence
  Synthetic
ALGTGQCNYSQDYQPNGRVLHDSHAIVTARRSLLRYFYRHLMLIFCTAPGSKLVLKQNTNIFLYMNQLPKGSAQLKSQLHPQSESATDKLTKFIEPVYINSILVGNCKDTRGLEIAVKQRIDDALTVELSLNWSRFKSLAKEAERNYHKAKIQSYQEAKKLLHS

SEQ ID NO: 282 - protein, 164 aa, Artificial Sequence
  Synthetic
ALGTGECNYSRRFESCGRLLHDSHAVVTARRSLLRYFYRHLLLIFCTAPGSKLTLKRNITLSLYMNQLPKGTAQLESEVHPQSESAGDKLTKFIEPVYISNILVGSCKDTKGLDITIKQRLDDELTSKLSLNWSRFRMLAREAGRDYHEAKVKSYQEAKSLLQS

SEQ ID NO: 283 - protein, 163 aa, Artificial Sequence
  Synthetic
AIGTGDTNTNQHATANGRLLHDSHAVVTARRSLLRYLYRHLLLIFQLDLNSQLTLKRNITIHLYMNQLPKGSAQLPPRLHPCSNSASDKITQFIEPIYVGSILIASCSDVRGLEIAVKQRVEGITSKLSMNWSRFNLVAKEAEREYYEAKMSSYQEAKIVLKT

SEQ ID NO: 284 - protein, 163 aa, Artificial Sequence
  Synthetic
ALGTGSSNTKASPAPTGRILHDSHAVVTARRSLMRFLYRNLLLVFQQDETTKLSFKNHITLHLYLSQLPKGASQIPSQLRPLSNSATDKVMQFIEPIYMSSIFIGSCSDIRGMEMAVNQRVDGITSALSLNWSRFNLVAKESQREYREAKMMAYQEAKSMLKS

SEQ ID NO: 285 - protein, 163 aa, Artificial Sequence
  Synthetic
ALGTGNLNTKESLTPSGRILHDSHAVVTARRSLMRYLYRHLLLIFQQDQNTKLSLKSHITLHLYLNQLPKGAAQIPSHLRPLSNSATDKITQFIEPIYVSSILIESCSDTRGMEVAINQRVDGITSKLSLNWSRFNLVSKEAQREYREAKMMAYQEAKSVLKS

SEQ ID NO: 286 - protein, 163 aa, Artificial Sequence
  Synthetic
ALGTGGFNTRESISSDGRIVHDSHAVVTARRSLMRYLYRNLLMVYQHKSNSNLSLKTGISLHLYVNSLPKGAAVIPSKLYPLSSSTADKITQFIEPIYVQSILISCCTDVRGMEVSVCQRVEGVTSQLGINWHRFKLVAKEAQRHYREAKRMAYQEAKSVLRA

SEQ ID NO: 287 - protein, 162 aa, Artificial Sequence
  Synthetic
ALGTGNFNAKESASTGGRIVHDSHALVSARRSLMRFLYRHLLMVFEQSGSGLSLKSGITLHLYVNQLPKGAAQIPSQLRPLSNSATDKLTQFIEPVYVHSILVVGCSDVRGLKMSVSQRVEGITSQLGINWHRFKLVAKEARRLYREAKRMAYQEAKNVLRA

SEQ ID NO: 288 - protein, 160 aa, Artificial Sequence
  Synthetic
ALGTGTKTMTGDYISSIGTAVIDCHGEIISRRNLKRYFYAELQKIFERKDGQFALRDGIKFHLYINTTTCGDARVFNPNSDFESSCSDKVMRLIEPIYLSSISLGLYHRQHFPRAMFERIDDIGLDFSINWQLYLLGYATKIYLDAKNLSYQSVKNGLYE

SEQ ID NO: 289 - protein, 161 aa, Artificial Sequence
  Synthetic
CLATGTKCLSGNYLSLSGESLHDCHAEILTRRCLLKFFYKELMEIFVFSGDKKFKLAEDIAFHLYINTAPCGEARVFSFCDENSCSDKLTLFIEPTYLESISISVFNINHMKRTIYGRVENSIDKYCVNWKEYIKLCSLSTLIYDLLKNKNYIAAKNQILS

SEQ ID NO: 290 - protein, 164 aa, Artificial Sequence
  Synthetic
SLATGNKCIKATSLSFDGCAVNDCHAEILTRRGLVRWLYTQVQLLVEQGEEGGKLRLRKRFSLHLFISTAPCGDGRVYQFGSNKDNSCSDKVLKFLHPLLICLSIYLSSLALHFTRESCIARACYGRVARFKPVSANWTRFAALTPYKDVKRSAYSKTQFELIR

SEQ ID NO: 291 - protein, 156 aa, Artificial Sequence
  Synthetic
SLSTGNKGLRGDKVVSDGTALIDCHAEILARRGLLRFLYSEILKIFMKKGTLVLRPGISFHLFINTAPCGAGRIDNKAKSVKASCSDKLLRFVEPIYYSSIAVEKNNVERLQRAVFGRAASSSVNWELMVHVCAITQTYDELKAGCYETEKKAFIA

SEQ ID NO: 292 - protein, 155 aa, Artificial Sequence
  Synthetic
SLATGNKGLRGDQITSDGSALIDCHAEILARRGLLRFLYSEVLKIFETGKLALRQGISFHLFINTAPCGTARVDRKVRTAEASCSDKLLRFIEPVYYASIAVEQNNFVRMNKAVYTRASSGSMNWELMVKTCFLTKTYEEMKAGCYSAAKKSFIM

SEQ ID NO: 293 - protein, 155 aa, Artificial Sequence
  Synthetic
SLATGNKGLSGDKIRSDGSALIDCHAEILAKRGLMRFLYSEVLKIFLESGLILKLGITFHLFINTAPCGTARVDKKMRNPESSCSDKLLRFMNPIYYSSIAVEKSNFERMNRAVNDRAAGGSMNWELMKTVCTLAKIYEELKAGSYAATKKEFYA

SEQ ID NO: 294 - protein, 155 aa, Artificial Sequence
  Synthetic
SLSTGNKGLRGDKIVNDGSALIDCHAEILARRGLLRFLYSEVIKIFERGTLVLKKGILFHLFINTAPCGTARVDRRMKTAEASCSDKLLRFIEPIYYTSIAVEQNNFDRLNKAVFARAANGSMNWELMMATCKLTQTYDELKAGSYLNAKQSFIK

SEQ ID NO: 295 - protein, 155 aa, Artificial Sequence
  Synthetic
ALSTGNKGLRGDKIVNDGTALIDCHAEILARRGLLRFLYSEVLKIFTKGKLVLKPGISFHLFINTAPCGVARIDKKLKTSDNSCSDKLLRFIDPIYYSSIAVELNNADRLRKAVYSRAATSSMNWELMITICTLTKTYEELKAGSYAAAKKSFIT

SEQ ID NO: 296 - protein, 158 aa, Artificial Sequence
  Synthetic
SIGTGTKFISGEYISDKGYAVNDCHGEIIARRGLRKFLYNQLELIFELKPSGYGLKDQVEFHLYISTSPCGDARVFSPHEPEEKSCSDKICKFIEPVYFTSIILSLYRYNHMARAMYERVGPVEDHSLNWTKFLALWARQYDEAKLSAYQKAKASLMM

SEQ ID NO: 297 - protein, 162 aa, Artificial Sequence
  Synthetic
SVGTGTKCVGGEHISVKGAVLNDSHAEIISRRGLVRYFYSQLLLIFIRNEDGQFCLKPEIRFHLYISTSPCGDARIFSPHDNTSSCSDKVAKFIEPIYLHSIVVSLFHQTHLRRALYGRIENTLIGHSINWIKFHELLRKTGITYSDAKELVYKDAKTYMIA

SEQ ID NO: 298 - protein, 162 aa, Artificial Sequence
  Synthetic
SVTTGTKCISGEHISMNGCSLNDMHAEILSRRCLITYFYDQLELIFTQREDGKYKLKPGLDFHLYINTAPCGDARIFSPHEEASSCSDKICRFIEPIYLKSIVLSLMREAHMYRALCGRIENTIQGFAVVWKRFARLVGSVTEIYCDVKDAVYKAAKTNLYE

SEQ ID NO: 299 - protein, 161 aa, Artificial Sequence
  Synthetic
CVTTGTKCVSGEHLSVSGGAVNDCHAEVVARRCLCEYLYKQLELILEPAKKGFKLKQGIQFHLYINTAPCGDARIFSPHEESASCSDKIARFIEPIYFHSIVLSLLNPSHMYRAVCGRIENTIQGYSVNWRRFFNLLGTIEDVYLEAKLSVYSLAKRQLKD

SEQ ID NO: 300 - protein, 160 aa, Artificial Sequence
  Synthetic
SVSTGTKCVSGEHMSVNGAVLNDSHAEIVSRRCLLKYLYAQLDLIFVRNTDGQYKLKSGVHFHLYINTAPCGDARIFSPHETGASCSDKIARIIEPVYLHSIVLSLLHPEHMYRAVCGRIEKSIQGFGINWDKYGFLMKGMQYGETKADVYQTAKQELFS

SEQ ID NO: 301 - protein, 161 aa, Artificial Sequence
  Synthetic
SLATGTKCVSGEHMSVTGSVINDSHAEIIARRGLLDFFYTQLDLIFVAPTDGTYKLKDGIHFHLYINTAPCGDARVFSPHENMDASCSDKISRVIEPIYLHSIVLSLLHPAHMYRAICGRIENSIQGFSINWRRFAAVIEHARYGETKMCVYQQAKKELFA

SEQ ID NO: 302 - protein, 160 aa, Artificial Sequence
  Synthetic
SVSTGTKCINGEYMSDQGLAVNDCHAEVIGRRSLMRYLYFQLGKIFQEKEGGFMLKPNIHFHLYISTSPCGDSRIFSPHEQEASCSDKIARFIEPVYFDSLILSLYHGDHLSRAVYSRISNIENFAVNWKRFLQLCGLTGQSYADAKVTVYQTAKQQMYL

SEQ ID NO: 303 - protein, 161 aa, Artificial Sequence
  Synthetic
SLATGTKCINGEYMSDQGMALNDCHAEIVSRRSLLRYLYSQLDLVFEPKEDGKYRLKDNIQFHLYISTSPCGDARIFSPHETDASCSDKIARFVEPIYLSSIILSLYHGDHLSRAVYQRLGELEQFSVNWQCWNKLFGTTGRHYSEAKLLNYQAAKQEMVK

SEQ ID NO: 304 - protein, 161 aa, Artificial Sequence
  Synthetic
SVSTGTKCINGEYMSDRGLALNDCHAEIISRRSLLRFLYTQLELIFQKSERGFRLKENVQFHLYISTSPCGDARIFSPHELEAASCSDKIARFVEPIYFSSIILSLYHGDHLSRAMYQRISNIEDFSVNWCRWMRVHGHLLRSYHESKLAAYQAAKARLFT

SEQ ID NO: 305 - protein, 160 aa, Artificial Sequence
  Synthetic
SISTGTKCINGEYMSDRGLALNDCHAEIIARRSLLRFLYTQLELIFQKSERGFRLKENVQFHLYISTSPCGDARIFSPHELEASCSDKMARFVEPIYFSSIILSLYHGDHLSRAMYQRISNIEDFSVNWCRWMRVHGNLLRSYHESKLAAYQAAKACLFK

SEQ ID NO: 306 - protein, 160 aa, Artificial Sequence
  Synthetic
CVSTGTKCINGEYMSDRGLALNDCHAEIIARRSLIRYLYSQLEFIFVHYEKGYRLKDNVQFHLYISTSPCGDARIFSPHEVEASCSDKIARFMEPIYFSSIILSLYHADHLSRAMYQRIADIEDFSVNWSRWVRLHSSILSNYHEAKQAAYHSAKQALIK

SEQ ID NO: 307 - protein, 161 aa, Artificial Sequence
  Synthetic
CISTGTQCIDGEHLSEDGLTVNDCHAEVVARRCLVRFLYSQLELIFRRGECGRFRLKDKVQFHLYVSASPCGDACIFSPHDVETSCSDKMARFTEPLYFSSIIVSLYHAAHMSRAMYGRIGPLEGFSENWCRWMQLHSSFLRVYHQAKRAAYCSAKHTLYR

SEQ ID NO: 308 - protein, 161 aa, Artificial Sequence
  Synthetic
CVSTGTKCIGREYMSNRGLALNDCHAEIVARRSLIRFLYSQLEYIFMRCDNSQFRVKENVQFHLYISTSPCGDARIFSPHEVDASCSDKIARFTEPIYFSSIILSLYHADHLSRAMYQRITEIEEFSVNWSRWMNLHCSMLWIYHDTKQAAYHSAKETLFR

SEQ ID NO: 309 - protein, 160 aa, Artificial Sequence
  Synthetic
ALSSGTKCISGEHLSDQGLVVNDCHAEVVARRAFLHFLYTQLELIFVRLKEGYRLRENILFHLYVSTSPCGDARLHSPYETDFSCTDKIARFVEPVYLQSIVVSLHHTGHLARVMSHRMEGVGQFSVNWARWAQLYGTRTPSYCEAKLGAYQSVKQQLFK

SEQ ID NO: 310 - protein, 160 aa, Artificial Sequence
  Synthetic
ALSSGTKCINGEYLNDQGLVVNDCHAEIIVRRAFLHFLYTQLELIFIRLKEGYRLRENIMFHLYVSTSPCGDARLHSPYESDFSCTDKITRFIDPIYLQSIIVSLHHTGHLSRVMSHRIEDLGNFSLNWTRWARLYGTRIGNYCDAKLAHYQSVKQQMFK

SEQ ID NO: 311 - protein, 160 aa, Artificial Sequence
  Synthetic
ALSTGTKCINGEYLSDQGLVVNDCHAEVTARRALLRFLYSQLEFIFVRHKERYRLRDNIHFHMYISTSPCGDGRLNSPYESDHSCTDKITRFVEPVYLHSVTISLRHTGHLGRVLNQRLERLGPMSVNWTRWSRLYRTHASSYAEAKMAAYQSVKQQWFR

SEQ ID NO: 312 - protein, 160 aa, Artificial Sequence
  Synthetic
ALSTGTKCINGEYMSDQGLVVNDCHAEVTTRRALLRFLYSHLELKLVQQGRGFRLRVCVIYHLMAFVADCQTARFASPFFLSFSCTDKIARFVEPVYLSSLTVSLRHTGHLSRTLSQRLERLGPYSVNWTRWTRLYRACAPGYCEAKQAAYQTAKEHWVR

SEQ ID NO: 313 - protein, 160 aa, Artificial Sequence
  Synthetic
ALSSGTKCINGEYISDQGLVVNDCHAEITTRRALLRFLYSQLELIFVRHKDSLRLRENVLFHMYISTSPCGDARVNSPYESDFSCTDKISRFVEPVYLYSLTVSLRHTGHFSRMMNHRMEKAGPYSVNWARWVRLYRVRGASYCEAKQAAYQTVKLQWLK

SEQ ID NO: 314 - protein, 160 aa, Artificial Sequence
  Synthetic
AISTGTKCINGEYISDRGLVVNDCHAEIIARRAFVRFLYSQLELIFIRHKEAYRLRENILFHMYISTSPCGDARLNSPYEADFSCTDKITRLVEPVYLHSLIVSLHHTGHLSRIVTHRLDRMGHFSVNWARWAKLYRTQVPNYCEAKLAAYQTVKQQLFK

SEQ ID NO: 315 - protein, 160 aa, Artificial Sequence
  Synthetic
SLATGTKCLDLEDESDSGRILRDCHAEVISRRALVRFLYAQLELIFVRNKDNFRLQEGILFHMYVSSSPCGDARLNCPYEAAFSCTDKLAKLVEPIYLHSLTVTLCHTGHLARGMARRLTPVKHISLNWTRWLQLQRGPVSGFSACKMSAYQRALRRFGS

SEQ ID NO: 316 - protein, 162 aa, Artificial Sequence
  Synthetic
SLATGTKCLDLGGVSDSGCTLTDCHAEVVSRRALVRFLYSQLELIFIPNKSCGDFRLREGVHFHMYVSSSPCGDARLNCPYEAAFSCTDKLAKLVEPVYLQSLTVTLSHTGHLGRAMARRLAPIKHISVNWARWLRLQQGPVIGYCASKMSAYQRAVQQFSS

SEQ ID NO: 317 - protein, 162 aa, Artificial Sequence
  Synthetic
SLATGTKCLDLDRLNEDGWTLRDCHAEVLSRRALVRFFYSQLELIFVPDKDSTHFRLQEGIRFHMYVSLSPCGDARLNCPYEPAFSCTDKIAKLVEPIYLHSLTVRLSHTGHLGRAVTRRLARVKHVCVNWSCWLRLENTPVSGYQASKMGAYQKAMQQFSN

SEQ ID NO: 318 - protein, 161 aa, Artificial Sequence
  Synthetic
SLATGTKCRDSDGVGDREGTLSDCHAEVLSRRALVRFLYAQLELIFVSNTAGGFRLRDGVFFHMYASSSPCGDARLNCPHEAAFSCTDKIAKLVEPVYLHSLTVTLSHTGHLGRAVARRLAPVRRIKIIAARSRDVLTRHLNSYSGSKMAAYQRAMQQFTG

SEQ ID NO: 319 - protein, 160 aa, Artificial Sequence
  Synthetic
SLATGTKCRDRGSAADGAGSLSDCHAEVISRRALLRFLYSQLELVLTPKPGGYRLRDGLLFHMYVSCSPCGDARLNCPYEAAFSCTDKLAKLIEPVYLQSLTVTLSHTGHLSRALTRRLAPVRRTSSNWARWRRLQQAHLDGYAGWKAAAYQRVMQTFSS

SEQ ID NO: 320 - protein, 160 aa, Artificial Sequence
  Synthetic
SLATGTRCPGRAGARDRAGTLSDCHAEVISRRALLRFLYWQLELIFTPNSGGCRLRDGVLFHMFVSSSPCGDARLNCPYEAAFSCTDKLAKLIEPVYLHSLTVTLSHTGHLSRAMARRLAPVRQISTNWVRWQQLQQPQLNGYSGWKGAAYRRMMQNFIS

SEQ ID NO: 321 - protein, 143 aa, Artificial Sequence
  Synthetic
KYPSRTYYKQTCIVCNITTGENTLFKLAKSDGKHAEELLLEELEKLVPKDSLTITIFMNDTPCSLAGHDCAGKFVQYLKTAKVDLTLYVTSLCESKKKDIHKGLAGLKQCTVKSPNRDAWQEFIMDLNDWKKYEKQEKDGIEK

SEQ ID NO: 322 - protein, 137 aa, Artificial Sequence
  Synthetic
NLDHQDWDKAKSCLICKIDDNITVLEKTEGTHAEEFLLQELEKKVRNVTIFMNNSPCSTPNHTCADKLLKYLDASENVRMTMYVTRLYMIARDGHHAGLQRLKQHACEINAFNKNWEELITKMEFKEYNVRSRKEED

SEQ ID NO: 323 - protein, 123 aa, Artificial Sequence
  Synthetic
YGNSKEQLFMLAKIPELFPESRHAEENLILGFSGIEQFFPEQIRKIDIFLSHSPCSEQGVKCSGSLYLNGCDQKLIAFFKKGNDLDRSLFLENSNVQVRYHRQFDSAVENFIIQAPELKDWKN

SEQ ID NO: 324 - protein, 126 aa, Artificial Sequence
  Synthetic
ISNELQVSAPKKKQRLFMLDNVPAVFPESNHAEENLIRRFPDVSQFFPGQIINITIFLSHSPCCAEGEKHSDARPINGCNKKLSVFFEKGNALDASLFVNTKFKVQYLYRFNHTVEPFIRQAPLLH

SEQ ID NO: 325 - protein, 126 aa, Artificial Sequence
  Synthetic
IGNELSKQDTPRKHQLFMIAKVPQLFPQHAQHAEENLIRGFPSINKFYPNQISKIDIFLTHSPCSEEGGKHSSQNSVNGCDKKLTVFFKKGNSADVQLFNRNTKVKVYYNHKFDSATDEFIKEAPI

SEQ ID NO: 326 - protein, 128 aa, Artificial Sequence
  Synthetic
IGNELKNSDLDRKQKLFMIGGVPQQFPRHSQHAEENLIRNFPNIKKFFPNQINTVEIFLTHSPCSSNGQKYSAQCYTNGCDKKLSAFFKKENYFDQQLFNRKVKVRIHYNHQFDPSINHFIKEAPILK

SEQ ID NO: 327 - protein, 149 aa, Artificial Sequence
  Synthetic
ERFLNAPLVRKPNTILMLRVQSEEMYLCYTRGYANSLHAEQFMMEDPELLRLLQPVRTLLMTLLMTQQPCHENAHASCTLRLLRWCKRERGIDLSIRIARVFRAADESARDGLRLLMRAPVEVAMLTCEDWQHCDERLVAFRPWHEMED

SEQ ID NO: 328 - protein, 154 aa, Artificial Sequence
  Synthetic
FFHCSPTPEARKTKGVVVAALRRGDLRSNSSHAEEYVVRDEELVRAVAPEDAGTLTLYQRLQPCHGSSDNRGSCSDAVAGLHRELLGVSLRVAVSYTYRAHVRGFREGIRVFAADGVTLEALNAEDWALCDEDYAAAFGGVFTAAVAHRRAMDE

SEQ ID NO: 329 - protein, 115 aa, Artificial Sequence
  Synthetic
PPPNIFLAQTREREAETGLRLLLYMTYQPCHHSGGRPKEALGTCSESLRDFYIKELGVALELVLADVYKATEELHREGMRMLLAEGITMRAMQPADWDLCDPEWAKRGAGPFSKH

SEQ ID NO: 330 - protein, 144 aa, Artificial Sequence
  Synthetic
CGKVVVAVALEHWRAGSSENVHAESFVIADETILSAVVAELTLYLSYQPCHHSGGRGGGEARQSCTEELIAYHERELNVPLSVVVADLYKVMEELMREGIRRLMSPGMSMRATGEEDWALCDQSYERRGGSAFGPHVALRAKLD

SEQ ID NO: 331 - protein, 152 aa, Artificial Sequence
  Synthetic
RGRRDGPVIVARVLGQSADLYVAYARGRSENVHAEEFMLADPQLLALLDAGGARILRLYMSYQPCHHSGGRKTPEDARKSCSERLRAFYEAEMAISLELVVADLYKAMEDLMRQGILLMVAPGVTMRATDENDWALCDPAYATRGGSAFSRH

SEQ ID NO: 332 - protein, 156 aa, Artificial Sequence
  Synthetic
VDTRDKTKAQVIVARVLGQNADLYVAYARGRSENVHAEEFMLADPQLLALLDASGARILRLYMSYQPCHHSGGRKTPEDARKSCSERLRAFYEAEMAISLELVVADLYKAMEDLMRQGILLLVAPGVTMRATDENDWALCDPAYETRGGSAFSRHE

SEQ ID NO: 333 - protein, 164 aa, Artificial Sequence
  Synthetic
SCKSFDERGASTMVACLRTTNGTYQEYRATDNDDRHPEEIFHKDMLQARTYVLPLTHIIVYLPTSPCFHQDCEPQCDVLDACAEQLAIVYRQAKKTDLKMSVKFLASYIGDLYKQGITMMMNAGIDVEPLGMRDWIELVHNDSTYYFSWKGLLTSYIRQSEIYI

SEQ ID NO: 334 - protein, 160 aa, Artificial Sequence
  Synthetic
RKLQYRGSSALVAQLTETATYRAFVVSEKTIHVEQKFYHQLMDAANFTMPLREVILYLPTSPCFHQDCDPLCDVLDACAEALSICYKQIRREELQMTVKFLASYVGDLYKQGIMSMMEAGLTVEPLNMKDWISLVSTAGTYYRDWENSLADYVMQTQLYI

SEQ ID NO: 335 - protein, 148 aa, Artificial Sequence
  Synthetic
AQLTETATYRAFVVSEKTVHVEQKFYHHLMDAANFTMPLRELILYLPTSPCFHQDCDPLCDVLDACAEALSICYKQIQREELQMTVKFLASYVGDLYKQGIMSMMEAGITVEPLNMKDWISLVSTAGTYYRDWENSLADYVMQTQLYI

SEQ ID NO: 336 - protein, 165 aa, Artificial Sequence
  Synthetic
LNEQVQKWEHRGASVMVAKLSDQQVYADYFVGDGKPQHVEQIFYTELMNADQCQMATLRQICLFMPTSPCFHQDCEPQCDVLDACAETLAIVYKQLQNSDLQMTVKFLASYVGDLYKQGILCMLQAGISVEPLNRKDWQALVEPDHTRAWDSLLTNYAMQSQFYI

SEQ ID NO: 337 - protein, 165 aa, Artificial Sequence
  Synthetic
LNEQVQKWEHRGASVMVAKLSDQQVYADYFVGDSKPQHVEQIFYTELMNADQCQMTTLRQICLFMPTSPCFHQDCEPQCDVLDACAETLAIAYKQLQNSDLQMTVKFLASYVGDLYKQGILCMLQAGISVEPLNRKDWQALVESDHSRSWDSLLTNYAMQSQFYI

SEQ ID NO: 338 - protein, 165 aa, Artificial Sequence
  Synthetic
PNEQVQKWEHRGASVMVAKLSDQHVYADYFVAETKPQHVEQIFYAELINADQCRMTTLRQICLFMPTSPCFHQDCEPQCDVLDACAETLAIAYKQLQNPDLQMTVKFLASYVGDLYKQGILCMLQAGISVEPLSRKDWYALVESDHTRGWDSLLTNYAMQSQFYI

SEQ ID NO: 339 - protein, 163 aa, Artificial Sequence
  Synthetic
VPKHVQNCEHKHESGLIVTLGDGYIYGDFFHDSNPHVEEQLVAAIYDLSKYKVDLYEIVIFVSKSPCFHQDCDPKCEVVDACAKLLGLLLSKVRKVDVRMTVKFLYPHLGDLYKQGILSMLQSGIKVEPLLMKDWSAVMDWAGEYLQWGSHLDRAVAQSQAFI

SEQ ID NO: 340 - protein, 163 aa, Artificial Sequence
  Synthetic
FHVPKHVQSCEHKHESGLIVTLGEDYIYGDFYHESSPHVEEQLVAAIYDLSKYKVDLYEIVIFVSKSPCFHQDCDPKCEVVDACAKLLGLLLSKVRKVDVKMTVKFLYPHLGDLYKQGILCMLQAGIKVEPLLMKDWSAIMDWTGEYLQWNNHLDKAVAQSQS

SEQ ID NO: 341 - protein, 165 aa, Artificial Sequence
  Synthetic
FHIPKHVQSCEQKHESGLIVTLGDDYVYGDFYHESNPHVEEQLVAAIYDLSKYKVDLYEIMIYVSKSPCFHQDCDPKCEVVDACAKLLGLLLSKVRKVDIRMTVKFLYPHLGDLYKQGILCMLQAGIKVEPLLMKDWSAVMDWSAEYLQWNNHLDKAVAQSQAFI

SEQ ID NO: 342 - protein, 164 aa, Artificial Sequence
  Synthetic
FHVPKHVQSCEQKHESGLIVTLGEDYIYGDFYHESSPHVEEQLVAAIYDLSKYKVDLYEMVIYVSKSPCFHQDCDPKCEVVDACAKLLGLLLSKVRKVDVKMTVKFLYPHLGDLYKQGILCMLQTGIKVEPLLMKDWSAVMDWSGEYLQWNNHLDKAVAQSQSF

SEQ ID NO: 343 - protein, 162 aa, Artificial Sequence
  Synthetic
IPKHVQSCEHKNESGLIVTLGDDYIYGDFYHESSPHVEEQLVAAIYDLSKYKVDLNEVVIYVSKSPCFHQDCDPKCEVVDACAKLLGLLLSKIRKVDVRMTVKFLYPHLGDLYKQGILCMLQAGIKVEPLLMKDWSTVMDWSGEYLQWNNHLDKAVAQSQSF

SEQ ID NO: 344 - protein, 162 aa, Artificial Sequence
  Synthetic
VPKHVQNCEHKNESGLIVTLGHDYVYGDFYHESSLHVEEQLAAAIYDLSKYKVDLFEAVIYVSKSPCFHQDCDPKCEVVDACAKLLGLLLSKIRKVDVKMTVKFLYPHLGDLYKQGILCMLQAGIKVEPLLLKDWSAVMDWTGEYLQWNNHLDKAVAQSQSF

SEQ ID NO: 345 - protein, 164 aa, Artificial Sequence
  Synthetic
FHLPKHVQSCEHKNETGLILTLGDDYIYGDFYHESSLHVEEQLVAAIYDLSKYKVDLFEAVIYVSKSPCFHQDCDPKCEVVDACAKLLGLLLSKIRKVDVKMTVKFLYPHLGDLYKQGILCMLQAGIKVEPLLLKDWSAVMDWTGEYLQWNSHLDKAVAQSQSF

SEQ ID NO: 346 - protein, 162 aa, Artificial Sequence
  Synthetic
VPKHVQNCEHKHESGLIVTLGEDYIYGDFYHESGPHVEEQLVAAIYDLSKYKIELYEIVIFVSKSPCFHQDCDPKCEVVDACAKLLGLLLSKVRKVDVKMTVKFLYPHLGDLYKQGILCMLQAGIKVEPLLMKDWSAIMDWAGEYLQWNNHLDKAVAQSQSF

SEQ ID NO: 347 - protein, 163 aa, Artificial Sequence
  Synthetic
VPKHVQNCEHKHESGLIVTLGEDYVYGDFYHESGPHVEEQLVAAIYDLSKYTVDLHEIQIFVSKSPCFHQDCEPKCEVVDACAKLLGLLLSKVRKVDVKMTVKFLYPHLGDLYKQGILCMLQAGIKVEPLLMKDWCAIMDWSGDYLQWNNHLDKAVAQSQLFI

SEQ ID NO: 348 - protein, 145 aa, Artificial Sequence
  Synthetic
IPKHVQNCDHKHESGLIVSLGDDYIYGDFYHESGPHVEEQLVANIYDLSRYKVDLHEIVIFVSKSPCFHQDCDPKCEVVDACAKLLGLLLSKIRKVDVKMTVKFLYTHLGDLYKQGILCMLQAGIKVGFFSVLQKAVAQSQLFIN

SEQ ID NO: 349 - protein, 163 aa, Artificial Sequence
  Synthetic
IPKHVQNCDHKHESGLIVSLGDDYVYGDFYHESGPHVEEQLVANIYDLSRYKVDLHEVVIFVSKSPCFHQDCDPKCEVVDACAKLLGLLLSKIRKVDVKMTVKFLYTHLGDLYKQGILCMLQAGIKVEPLLMKDWCAIMDWSGDYLQWNNHLDKAVAQSQLFI

SEQ ID NO: 350 - protein, 163 aa, Artificial Sequence
  Synthetic
VPKHVQNCDHKHESGLIVSLGENYIYGDFYHESGPHVEEQLVANIYDLTKYNVELHEIVIFVSKSPCFHQDCDPKCEVVDACAKLLGLLLSKVRKVDVKMTVKFLYPHLGDLYKQGILCMLQAGIKVEPLLMKDWCAIMDWSGDYLQWNNHLDKAVAQSQLFI

SEQ ID NO: 351 - protein, 158 aa, Artificial Sequence
  Synthetic
FSVPKHVQNCDHKHESEDYIYGDFYHESGPHVEEQLVANIYDLTKYNVELHEIVIFVSKSPCFHQDCEPKCEVVDACAKLLGLLLSKVRKVDVKMTVKFLYPHLGDLYKQGILCMLQAGIKVEPLLMKDWCAIMDWSGDYLQWNNHLDKAVAQSQLFI

SEQ ID NO: 352 - protein, 140 aa, Artificial Sequence
  Synthetic
VPKHVQNCDHKHESGLIVSLGEDYIYGDFYHESGPHVEEQLVANIYDLSKYNVELHEIAIFVSKSPCFHQDCDPKCEVVDACAKLLGLLLSKVRKVDVKMTVKFLYPHLGDLYKQGILCMLQAGIKVCGHFFVCFAYLFV

SEQ ID NO: 353 - protein, 161 aa, Artificial Sequence
  Synthetic
FAVTKNTKQCGQKNETAAIVTLGGGNIEFHHESSLHPEEQLFTALMELSEYQVNLEEVVLYCSKSPCYHQDCNPLCEVIDACAKLLVLLLYKVRTVDVNLTVRFLYPHLGDLYKQAIMYMLQHGINVEPLLMSDWSAIVEWGCNYLDWNEHLDQAVARGQS

SEQ ID NO: 354 - protein, 164 aa, Artificial Sequence
  Synthetic
FLVSRSTQQCEHKHESAIVVTLGEDYVYIEYAHESGLHCEEQLMNALEELAMYTVNLYEVVVYTSRSPCFHQNCEPRCAVIDACSKLLSLFLLKLRRVDLRMTVRFLFPHLGDLYKQGILCMLQHGIKVEPLLMKDWSAIMDWSGDYLAWNQYLDHAVAKSQSF

SEQ ID NO: 355 - protein, 162 aa, Artificial Sequence
  Synthetic
ISRTTQHCEHKHESAIVVTLGEDYVYVEYLHESSLHCEEQLLYALEELAKYAINLYEVLVYTSRSPCFHQNCEPRCAVIDACSMLLSLFLFKLRRVDLRMTVRFLFPHLGDLYKQGILCMLQHGIKVEPLLMKDWSGIMDWAGDYLTWNQHLDQAVAKSQSF

SEQ ID NO: 356 - protein, 162 aa, Artificial Sequence
  Synthetic
VSRTTQHCEHKHESATVVTLGEDYVYVEYLHESSPHCEEQLLFALEELAKYAINLYEILVYTSRSPCFHQNCEPRCAVIDACSMLLSLFLFKLRRVDLRLTVRFLFPHLGDLYKQGILCMLQHGIKVEPLLMKDWSGIMDWAGDYLAWNQHLDQAVAKSQSF

SEQ ID NO: 357 - protein, 148 aa, Artificial Sequence
  Synthetic
SRQGQQCEQKHESVILVTLGEDYVYVEFCHESSRHCEEQLAIALHELVNRSPCFHQDCEPRCDVIDACSKLLALLLTKVRKADIRMTVRFLFPHLGDLYKQGILCMLQHGIKVEPLLMRDWSAIMDWAGDYLGWNEHLDQAVAKSQSF

SEQ ID NO: 358 - protein, 161 aa, Artificial Sequence
  Synthetic
SRQGQQCEQKHESVILVTLGEDYVYVEFCHESNRHCEEQLAIALHELVKYKINLYEILIYSSRSPCFHQDCEPRCDVIDACSKLLALLLTKVRKADIRMTVRFLFPHLGDLYKQGILCMLQHGIKVEPLLMRDWSAIMDWAGDYLGWNEHLDQAVAKSQSF

SEQ ID NO: 359 - protein, 146 aa, Artificial Sequence
  Synthetic
WTAFYINGRPKLKKCITLCHVVFNETATAEQWEISYSHGPHAEIKVLRNIKARELCLGYTRIVTLFLSYSPCANCANFIIEFSRTRPQCTVYIRFTCLFRHPEEIHRDGLRRLNAPGISLGVFTVYEWRRLAEAGMPFRPWDSKWK

SEQ ID NO: 360 - protein, 150 aa, Artificial Sequence
  Synthetic
FYGKFNNTRKNGRNMLCFSLEGENKPWKWGYAHNSKHAENIVLREVASYKPFLNHFYISYGPCSNCCDKILDFLQKFEKIKIMIKISRLYKDESSVFQNSIKKLHQMGVSVQVMNRGDFEQCFKGFVQGDFQPWPALEPTSEKCAANLEA

SEQ ID NO: 361 - protein, 151 aa, Artificial Sequence
  Synthetic
FEAEFNNTVNSFRTLLCFSLQQENKTWNWGYAHNNDSHAEILVLREIEKYEKADHEIRQRVTLYVTCSPCNRCCTKILEFFQRFQRFDMDIKISKIYDLDSLQDLKQLGVSLKVMDSSDFKECFDLFVHTAEFEPWPGLEEKTKQLNAVFL

SEQ ID NO: 362 - protein, 158 aa, Artificial Sequence
  Synthetic
FYQEFCNTLRTCRTLLCFSLCQSTKIWDWGYAYNKGSHAESMVLEEIKTFQNQDKTLKYTLTLYMSFSPCNECCYRLATYAKLERRIKINVMFSKLYFPEHRKIQKGLQYLECAGVSLKVMEKQDFVTCFYLFVTEHAFQEWHCLDDMTKQYSSTLQA

SEQ ID NO: 363 - protein, 155 aa, Artificial Sequence
  Synthetic
FEENFNNTVLVRKTLILFSFKKRSSIWKWGYAYNDGQHAECLVLSNIEQFENQIKGKYKMTFFMSHTPCHKCSDKIVSFLASRKGLSMKIKASRPYFLNEGRKGLYLLKRIGVLLKMMDRTDFEECFYLFVHPLTFTPWSDLDEQSKKNMDDLAA

SEQ ID NO: 364 - protein, 158 aa, Artificial Sequence
  Synthetic
FYEHFCNIKTPHQTLLCFSLKEDDKTWKWGHAYNNGYHAEILVLREIEDYANILNATKYTITWFLSYSPCHCCCDEITNFLMKFQKIEFNIKAARPYYFDNDKNQKGLKILKKLGVLIKMMDFTDYEECLYLFVDPCKFTAWPDLEVQSIANKMIFHH

SEQ ID NO: 365 - protein, 154 aa, Artificial Sequence
  Synthetic
FHRNFSSTKASHQTLLCFGLKEEDKTWKWGHAYNNGCHAEILVLREIENYTNIPNAAKYNITWFLSYSPCHSCCDKIINFFMNSQKIEFNIKAAKPYQFSNDQNPKGIKMLNKLGILFKMMEYSDFEECFYLFVDPCKFTAWPDLEAQSIANIT

SEQ ID NO: 366 - protein, 104 aa, Artificial Sequence
  Synthetic
LFEAGGYLDAVTCENIRCIILYSSYSPCNEVPHCCVSKIYNFSLKYPEITLCIYFSQLYHTQCPSAREALRSLWSPRVTLQRPPGELWPSFVCGGSLSHPLRTS

SEQ ID NO: 367 - protein, 103 aa, Artificial Sequence
  Synthetic
FEVGGYLDAVVYKNIRCIILYANYSPCNEAYHCCISKIYNFLLKYPEITLCIYFSRLYHTEFPTAQEALRSLSSPRVTLQRLPAGTQHYFVYGGPLYHPSRTL

SEQ ID NO: 368 - protein, 102 aa, Artificial Sequence
  Synthetic
EVGGYLDTVVYENIRCIIVYSNYSPCNEAYHCCVSKIYNFLLRYPEITLCIYFSKLYHTEFPTSREALRSLSSPQVTLQRLPGGAWHYFVYGGSLYHPSRTL

SEQ ID NO: 369 - protein, 104 aa, Artificial Sequence
  Synthetic
EVGGYLDAVAYENIRWIILYSNYSPCNEAHHCCVSKIYNFLLKYPEIRLCIYFSQLYHTEFPTAREALRSLSSPRVILQRLPGGMWHYFVYGGSLYHLSRTLQQ

SEQ ID NO: 370 - protein, 103 aa, Artificial Sequence
  Synthetic
EVGGYLDAVAYENIRCIILYSNYSPCNEAYHYCISKIYNFLLKYPEITLCIYFSQFYHTEFPTAREALRSLSSPRVTLQRLPGGARRYFVYGGALYHPSRTLR

SEQ ID NO: 371 - protein, 104 aa, Artificial Sequence
  Synthetic
LFEMGGYLDAVAYENIRRIILYSTYSPCNEAYHCCISKIYNFLLKYPEITLCIYFSQLYHTESPTAREALRSLSSPRVTLQRLPAGAQRYFVYGGSLYHPSRTL

SEQ ID NO: 372 - protein, 103 aa, Artificial Sequence
  Synthetic
EVGGYLDAVAYENMGCIILYSNYSPCNEAYHCCVSKIYNFLLKYPEITLCIYFSQLYHTEFPTAREALRSLSSPRVTLQRLPGGAWRYFVYGGSLYHPSRTLR

SEQ ID NO: 373 - protein, 99 aa, Artificial Sequence
  Synthetic
GYLDAVACENIGCIILYSNYSPCNEAHHFCISKIYNFLLKYPEIALCIYFSQLYHTEFPSAREALRSLSSPRVTLQRLPGGTWRYFVYGGSLYHPPRTL

SEQ ID NO: 374 - protein, 159 aa, Artificial Sequence
  Synthetic
RAFGFPCRAPQTHHLLFYELKSFSGTVVQKGHATSEDNHPESMLFEADGYLDAVAYRNIGCITLYSNYSPCNEAYHCCVSKIYNFLLKYPEITLCLYFSQPYHTEFPTARQALHSLASPQVTLQPLPTGTWCHFVYGGSLQHPPGTLRQNPHQINNFRG

SEQ ID NO: 375 - protein, 160 aa, Artificial Sequence
  Synthetic
LRAFGFPCRAAQTHHLLFYELRSFSGTVVQKGHASSEDSHPESMLFEADGYLDAVAYGNTGCITLYSNYSPCNEAYHCCISKIYNFLLKHPETTLCLYFSQPYHIEFPTARQALRSLASPWVTLQPLPMGTRCHFVYGGSLQHPPGTVGQNPHQINNLRG

SEQ ID NO: 376 - protein, 77 aa, Artificial Sequence
  Synthetic
LFEVGSYLDAVAHENVGCIILYSNFLPCNEAYHCCISNIYNFLLKYPEITLCIYFSQLYHTQFCATRKALQSFSSEN

SEQ ID NO: 377 - protein, 101 aa, Artificial Sequence
  Synthetic
VGGYLDAVAYGNIGCIILYSNYSPCNEAYHCCISKIYNFLLKYQEIILRIYFSQLYHTEFPTACRALWSLSSPRVTLQRLPGGAWHYFVHGGSFYHPSRTL

SEQ ID NO: 378 - protein, 104 aa, Artificial Sequence
  Synthetic
LFEAGGYLDSVTYESIGHIILYSNYSPCNEADHCCISKIYNFLIKHPEVTLCIYFSQLYHTEFPTAREALRSLSSPHVTLYPLSGGIRHYFVYGRSLYHPSRTL

SEQ ID NO: 379 - protein, 102 aa, Artificial Sequence
  Synthetic
LFEAGGYLDAVTYEDIGYIILYSNYSPCNEADHCCLSKIYSFLTKYPQVTLCIYFSKLYHIELPTAHEVLKSLSSPHVTLHPLCGGIWHYFVHGGSLYHPSR

SEQ ID NO: 380 - protein, 160 aa, Artificial Sequence
  Synthetic
FHQAFGFPYTHQNKHLLFYEVRHFSGKLMQKGHATNEDIHPESMLFETGGYLDSINWENVMYIILYSNYSPCNEAEQCCISKIYHFLMKYPGITLCIYFSQLYHTELPISCEALQSLASPQVTLNPLCGGLWHSFVTSQACYHPIRALRQNAQQINNITG

SEQ ID NO: 381 - protein, 160 aa, Artificial Sequence
  Synthetic
FHKAFGFPYMPQNKHLIFYELRSFSGTLVQKGHATNKNIHPESMLFEMGGYLDALDYDSIRYIILYSNYSPCNEAEHCCISKIYNFLTKYPDITLCIYFSQLYHMEFPVSCEALRSLASPHVTLNPLCGGVWHSFVSGEALYHPARALQQNSYKINNITG

SEQ ID NO: 382 - protein, 153 aa, Artificial Sequence
  Synthetic
FYEAFGFPYTPRNKHLLFYELRNISGTLIQKGQATNLNLHPESTLFDLDGYLDSIIYDNISYITLYSNYSPCNESNHYCIGKMYDFLISYPSTRLDIYFSQLYHTDFPESREALRSLAGPRVTISPISGGTWLSFVNGQALYNPTRAFKHNAY

SEQ ID NO: 383 - protein, 160 aa, Artificial Sequence
  Synthetic
FYEAFGFPYTPENKQLIFYEVKDFSGTNIQKGQVTNSNIHAESILFEDSGYLDALHHGSVGYITLYANYTPCNEYGHYCISKMYNFLLKYEDTRLDIYFSQLYHVESPAARQALRSLASPRVTVNPLSEGIWQTFAKGLSFYEPARASSSNASTIHLITG

SEQ ID NO: 384 - protein, 157 aa, Artificial Sequence
  Synthetic
FYQTFGFPHMPQPEHLTFYELKTFSGAPVQKGQATSQSIHPESMLFEEGGYLDSVYDDSIGHIILFSNYTPCNEAGHCCISQMFDFLMTYPDITLSIYFSQLYHTEFPASRKALRSLASPRVSVNPISGGIWHAFVSGGALRHPSRALGHNAYEINA

SEQ ID NO: 385 - protein, 154 aa, Artificial Sequence
  Synthetic
FYQIFGFPYSPQTQHLTFYELKTSSGSLVQKGHASGEDTHPESMLFEMDSYLEAVNNDNIEHVFLYSNYCPCNEANHCCISKMYNFLMRYPAISLNIYFSQLYHTEFPVSREALRSLASPQVTVNPMSGGIWHYFVSDEALHQPARTLRHNAYE

SEQ ID NO: 386 - protein, 144 aa, Artificial Sequence
  Synthetic
FHQIFRFPYTPSTKHLTFYELKTFSGSLVQKGHASNGHTHPESMLFEMNGYLDSANNSSIKHIILYSNNSPCNEANHCCISKMYNFLTMYPDVTLSVYFSHLYHTGFPASREALRSLASPQVTLSPISGGIWHCFVTGGAAFQP

SEQ ID NO: 387 - protein, 154 aa, Artificial Sequence
  Synthetic
FHQVFGFPHTPPTKHLTFYELKTSSGTLVQKGHASNGDTHPESMLFEMNGYLDSASNSTIKHIILYLNNFPCNEANHCCISKMYNFLMMYPDITLSIYFSQLYHTKFPTSREALRSLASPQVTLSPISGMIWHSFVMGGPAFQPGRALRHNAYE

SEQ ID NO: 388 - protein, 160 aa, Artificial Sequence
  Synthetic
FHQTFGFPWTPQTKHLTFYELRSSSKNLIQKGLASNGHNHPEAMLFEKNGYLDAVHNSNIRHIILYSNNSPCNEAKHCCISKMYNFLMNYPEVTLSVFFSQLYHTEFPTSRKALQSLASPQVTLSPICGGLWHAFVSNGSVPQPGRILRYNTYEINSIIA

SEQ ID NO: 389 - protein, 160 aa, Artificial Sequence
  Synthetic
FHQTFGFPWTPQTKHLTFYELRSSSGNLIQKGLASNGHTHPESMLFERDGYLDSLHDSNIRHIILYSNNSPCDEANHCCISKMYNFLMNYPEVTLSVFFSQLYHTEFPTSREALRGLASPQVTLSAISGGIWQSFVSGGLAVRPGRTLRYNAYEINCITE

SEQ ID NO: 390 - protein, 158 aa, Artificial Sequence
  Synthetic
FYQIFGFPYMPQTKHLTFYELKTTSGSLVQKGHASSGNTHPESMLFELNGYFDSANNDSIRHIILYSNNSPCNEANHCCISKMYNFLIMYPHVTLSIYFSQLYHTEFPASREALRSLASPQVTLSPISGGIWHSFVSGGPVFQPGRALRHNAYEINAI

SEQ ID NO: 391 - protein, 157 aa, Artificial Sequence
  Synthetic
FYQIFGFPYTPQTKHLTFYELKTSTGGLVQKGHASSTSTHPESMLFETNGYFDWANNGGIRHIILYSNHSPCNEADHCCISKMYNFLTTYPDVTLSIYFSQLYHTDFPASREALRSLASPKVTLSPISGGIWHFFVSGGSVFQPGRALRHNAYEINA

SEQ ID NO: 392 - protein, 160 aa, Artificial Sequence
  Synthetic
FYQLFGFPYTPQTKHLAFYELRPSSGSLVQKGHASSGDTHPESMLFERNGYFDSANNNGIRHIILYSNNSPCNEANHCCISKMYNFLRMYPDVTLSIYFSQLYHTEFPASREALRSLASPQVTLSPISGGIWHSFVSGGWLFQPGRALRHNAYEINAITG

SEQ ID NO: 393 - protein, 127 aa, Artificial Sequence
  Synthetic
FYQLFGFPYVPQTKHLTFYELKTSPGSLVQKGHENSGDTHAESMLSEMNGYFDSANHQGIRHIILYSNNSPCDEANHCCTSKMYNFLTMYPDVTLSIYFSQLYHTEFPASREALRSLASPQVTVSPP

SEQ ID NO: 394 - protein, 158 aa, Artificial Sequence
  Synthetic
FYQIFGFPYISQTKHLTFYELKTSSGSLVQKGHASRGDTHPESMLFEMNGYLDSANNDGIRHIILYSSNSPCNEANHCCISKMYNFLKVYPDVTLSVYFSQLYHTEFPASREALRSLASPQVTLSPISGGIWHSFVSGGSVFQPGRALRQNAYEINAI

SEQ ID NO: 395 - protein, 159 aa, Artificial Sequence
  Synthetic
FYQIFGFPYTPPTKHLTFYELKTSSGSLVQKGHASSGDTHPESMLFEVNGYFDSANNDCIRHIILYSSNSPCNEANHCCISKMYTFLAKYPDITLSVYFSQLYHTEFPASREALRSLASPQVTLSPISGGIWYSFVSGGAVFQPGRALRHNAHEINAIT

SEQ ID NO: 396 - protein, 160 aa, Artificial Sequence
  Synthetic
FYQIFGFPYTPPTKHLTFYELKTSSGSLVQKGHASSGDTHPESMLFEMNGYFDSASNDGMRHIILYSSNSPCNEANHCCISKMYTFLAKYPDITLSIYFSQLYHTEFPASREALRSLASPRVTLSPISGGMWYSFVSGGAVFQPGRALRHNAHEINAITG

SEQ ID NO: 397 - protein, 160 aa, Artificial Sequence
  Synthetic
FYQIFGFPYTPQTKHLTFYELKTSSGSLVQKGHASSGNTHPESMLFEMNGYFDSANNNAIRHIILYSNNSPCNEANHCCISKMYNFLILYPDITLSIYFSQLYHTEFPASREALRSLASPQVTLSPISGGMWHSFVSGGSVFQPGRALRHNAYEINAITG

SEQ ID NO: 398 - protein, 160 aa, Artificial Sequence
  Synthetic
FHQIFGFPYVPQTKHLTFYELKTSSGSLVQKGHASSENTHPESMLFEMNGYFDAAKNNAIRHIILYSNNSPCNEANHCCISKMYNFLIMYPDVTLSIYFSQLYHTEFPASREALRSLASPQVTLSPISGGIWHSFVSGGPVFQPRRALRHNAYEINRITG

SEQ ID NO: 399 - protein, 159 aa, Artificial Sequence
  Synthetic
FYQIFGFPYAPQTKHLTFYELKTSSGSLVQKGHASSGNTHPESMLFEMNGYLDSANNNAIRHIILYSSNSPCNEADHCCISKMYNFLIMYPDVTLSIYFSQLYHTEFPASREALRSLASPQVILSPISGSIWHSFVSGGSVFPPGRAQRHNAYEINAIT

SEQ ID NO: 400 - protein, 160 aa, Artificial Sequence
  Synthetic
FYQIFGFPYVPQTKHLTFYELKTSSGSLVQKGHASSGNTHPESMLFEMNGYFDSANNNTIRHIILYSNNSPCNEANHCCIGKMYNFLITYPDVTLSIYFSQLYHTEFPASREALRSLASPRVTLSPISGGIWYSFVSGGSVFQPGRALRHNAYEINAITG

SEQ ID NO: 401 - protein, 160 aa, Artificial Sequence
  Synthetic
FYQIFGFPYTPQTKHLTFYELKTSSGSLVQKGHASSGQIHPESMLFEMNGYLDLANNGGIRHIVLYSNHSPCNEAHHCCISKMYNFLITHPDITLSIYFSQLYHTEFPTSREALRSLASPRVTLSPISGGIWHSFVSGGSVFQPGRALRHNAYEINAITG

SEQ ID NO: 402 - protein, 157 aa, Artificial Sequence
  Synthetic
FCQIFGFPYTPQTKHLTFYELKTSSGNLVQKGHASSGYIHPESMLFEMNGYLDSANNDNIRHIILYCNNSPCNEANHCCISKVYNFLITYPGITLSIYFSQLYHTEFPASREALRSLASPRVVLSPISRGIWHSFVSGGSVFQPGRALRHNAYEINA

SEQ ID NO: 403 - protein, 154 aa, Artificial Sequence
  Synthetic
FCQIFGFPYTHQTKHFTFYELKTPSGSLVQKGHASSGYIHPESMLFEMNGYLDSASNDSIRHIILYSSNSPCNEANHCCISKMYNFLITYPGVTLSIYFSQLYHTEFPASREALRSLASPQVILSPISGGIWHSFVSGGSVFQPRRALRHNAYE

SEQ ID NO: 404 - protein, 154 aa, Artificial Sequence
  Synthetic
FCQIFGFPYAPQTKHLTFYEVKTSSGSLVQKGHASSGDIHPESMLFEMNGYLDSANNDSIRHIILYSSNSPCNEANHCCISKMYNFLITYPGVTLSIYFSQLYHTEFPASREALRSLASPRVVLSPISGGIWHSFISGGSIFQPGRALRHNAYE

SEQ ID NO: 405 - protein, 154 aa, Artificial Sequence
  Synthetic
FCQIFGFPYTPQTKHLTFYELKTSSGSLVQKGHASSGYIHPESMLFEMNGYLDSANNDSIRHIILYSNNSPCNEANHCCISKMYNFLITYPGITLSIYFSQLYHTEFPASREALRSLASPRVVLSPISGGIWHSFISGGSVFQPGRALRHNAYE

SEQ ID NO: 406 - protein, 151 aa, Artificial Sequence
  Synthetic
DPSVLRRVQYLLYEVKWSNSRKLTQCCHSTRTEHAEIYFLEDVFHRQRYDPSDHCSLTWYMSWSPCGECCKAIRDFLKEQPNVNLVIYVARIYCHEEENNRQGLRSLVNIVTIRIMDLPVYSYCWRTFVCDEDKDEDYWPRHFAPWIMLYS

SEQ ID NO: 407 - protein, 117 aa, Artificial Sequence
  Synthetic
HAEIYFLKDVFNRQRNDPSDHCSLTWYMTWSPCGECCKAIRDFLKEQPNVNLVIYVARIYCHEEENNRQGLRSLVNIVTIRIMDLPVYSYCWRTFVCDEDNFPGSPEGSHHKSMLLT

SEQ ID NO: 408 - protein, 73 aa, Artificial Sequence
  Synthetic
ITLYLSWSPCRNCCYEMQYFLKKHPNVNICIYLARLYYTEDEEICKALKDLSEKVIISVMKIEDYIYCWKTFV

SEQ ID NO: 409 - protein, 62 aa, Artificial Sequence
  Synthetic
ITWYLSWSPCVNCCYKIRDFLNRHSYVTIRIYVARLCYRGFHRNRKGLRNLVSLRVTVNVME

SEQ ID NO: 410 - protein, 64 aa, Artificial Sequence
  Synthetic
ITWYLSWSPCVNCCNEILDFLERHENVNIDIHVARLYFKDSKRTHRALKELARSTVSINVMNME

SEQ ID NO: 411 - protein, 151 aa, Artificial Sequence
  Synthetic
QRNFDPREFPECTLLLYEIHWDNNTSRNWCTNKGLHAEENFLQIFNEKIDIRQDTPCSITWFLSWSPCYPCSQAIIKFLEAHPNVSLEIKAARLYMHQIDCNKEGLRNLGRNRVSIMNLPDYRHCWTTFVVPRNEDYWPQDFLATNYSREL

SEQ ID NO: 412 - protein, 62 aa, Artificial Sequence
  Synthetic
ITWYLSWSPCMTCCYIIRNFLVRHPNVNIEIHVARLYNTRWAGTRRGLRELARLRVTIDVME

SEQ ID NO: 413 - protein, 154 aa, Artificial Sequence
  Synthetic
FDPRTYPSETYLLCELQWGGSGRFWIHWARNDEDSHVEHYFLEQIFEPRSYSVCDITWYLSWSPCANCCDIIQEFLEEQHNVNLDIRVARVYNEHIRENRAALRQLANFQAAIRAMDVEDYMYCWDTFLQQGGYFDFTAGSFRSAVERTRLRLE

SEQ ID NO: 414 - protein, 75 aa, Artificial Sequence
  Synthetic
DMTWYLSWSPCGECCDIIQDFLEEQPNVNINIRVARLYYTDRASNRKGLRELASSPVTLEIMDAEDYNYCWETFI

SEQ ID NO: 415 - protein, 64 aa, Artificial Sequence
  Synthetic
ITWYLSWSPCANCCYEIVDFLQRHSYVNIKIFVARLYYIDRERNRQGLRDLMNSAVTIDVMDIE

SEQ ID NO: 416 - protein, 64 aa, Artificial Sequence
  Synthetic
ITWYLSWSPCANCCYRIVQFLMKHSYVSIDIRVARLYFIEDETTRQGLEELVSCAVRLTVMDTE

SEQ ID NO: 417 - protein, 69 aa, Artificial Sequence
  Synthetic
ITWYLSWSPCACCCCKIQDFLKMNSYVNTDIDVAQLYGNYQEQNCQGLKNLKSLAVTIAVMRIEDKISC

SEQ ID NO: 418 - protein, 64 aa, Artificial Sequence
  Synthetic
ITWYLSWSPCANCCRKIRNFLKKHSYVYIDIYVARLYYIDDEENRRGLRNLQSLDVTIAVMEIE

SEQ ID NO: 419 - protein, 64 aa, Artificial Sequence
  Synthetic
ITWYLSWSPCADCCCKIVNFLKKHSYVNMRIYVARLYYPEYETNRRGLKNLRNLAVPIAVMEIE

SEQ ID NO: 420 - protein, 159 aa, Artificial Sequence
  Synthetic
FEKNYKPIDGTKEAHLLCEIKWGKYGKPWLHWCQNQRNIHAEDYFMNNIFKAKKHPVHCYVTWYLSWSPCADCASKIVKFLEERPYLKLTIYVAQLYYHTEEENRKGLRLLRSKKVIIRVMDISDYNYCWKVFVSNQNGNEDYWPLQFDPWVKENYSRL

SEQ ID NO: 421 - protein, 64 aa, Artificial Sequence
  Synthetic
ITWYLSWSPCARCCYKILDFLKEHSYVNLHIYVARLYCIEDEKTRRGLKKLNSLEVTIAVMEEE

SEQ ID NO: 422 - protein, 64 aa, Artificial Sequence
  Synthetic
ITWYLSWSPCAKCCYEILNFLKKHPNVNIDIYVARLYDIEKEKTRQGLKNLVRLPVTIAVMEME

SEQ ID NO: 423 - protein, 64 aa, Artificial Sequence
  Synthetic
ITWYLSRSPCAKCCYEILDFLNKHSNVNIDIYIAQLYKIKNEENCQGLRNLVSLAVTIAVMEIE

SEQ ID NO: 424 - protein, 137 aa, Artificial Sequence
  Synthetic
SELTWGGRPYKHWYENTEHCHAEIHFLENFSSKNGSCIITWYLSWSPCAECSARIADFMKENTNVKLNIHVARLYLHDDKHTRQGLRYLMKMKVTIQIMTIPDYKYCWNTFLEDDGEDESDDYGGYAGVHEDEDESD

SEQ ID NO: 425 - protein, 64 aa, Artificial Sequence
  Synthetic
ITWYLSWSPCAECCLKILNFLEENSNVNIDIHIARLYRIQDERNRQGLRELVSSEVTIAVMGIE

SEQ ID NO: 426 - protein, 64 aa, Artificial Sequence
  Synthetic
ITWYLSWSPCAKCCRKILNFLKMHSNVKIDIYVARLYYIEDEKNRQGLKKLVSLAVKIAVMEIE

SEQ ID NO: 427 - protein, 74 aa, Artificial Sequence
  Synthetic
VTWYLSWSPCVNCCRKILNFLKKHSNVNIDMHVARLYYIEDERIRQGLKNLVSLAVTIAVMEIEDYTYCWKNFI

SEQ ID NO: 428 - protein, 64 aa, Artificial Sequence
  Synthetic
ITWYLSWSPCAHCCRKILNFLKRHSDVNIHIYIARLYYIENEEIRQGLKNLVSLEVKIAVMETE

SEQ ID NO: 429 - protein, 64 aa, Artificial Sequence
  Synthetic
ITWYLSWSPCVNCCRKILKFLKQHSYVNIKIYVARLYYIDDDEIRQNLKNLVSLVVTIAVMDIE

SEQ ID NO: 430 - protein, 159 aa, Artificial Sequence
  Synthetic
  misc_feature (11)..(11): Xaa can be any naturally occurring amino acid
  misc_feature (105)..(105): Xaa can be any naturally occurring amino acid
  misc_feature (123)..(123): Xaa can be any naturally occurring amino acid
LKYHFDPREVXRDTYLLCILRWGETGTPWSHWVKNRYHAEVYFLEKIFQTRKSSKNINCSITWYLSWSPCAKCCRKILNFLKKHSYVSIKIHVARLFRIDDKETXQNLKNLGSLVVTVSVMEXEDYTNCWKTFIRGHADGDSWIDDLKSEIRKNRLKFQ

SEQ ID NO: 431 - protein, 64 aa, Artificial Sequence
  Synthetic
ITWYLSWSPCADCCHKILKFLKKHSNVNIDIHVARVYYAEDEKVRQGLKNLVSLAVTIAVMETK

SEQ ID NO: 432 - protein, 64 aa, Artificial Sequence
  Synthetic
ITWYLSWSPCADCCRKILNFLKKNSNVNIDIYVARLYYTEDEKIRQGLQNLVSLAVTIAVMETE

SEQ ID NO: 433 - protein, 64 aa, Artificial Sequence
  Synthetic
ITWYLSWSPCADCCHKILNFLKRHSNVNIDIYVARLYYIEDEEIRQCLKNLVSLAVTIAVMKIE

SEQ ID NO: 434 - protein, 68 aa, Artificial Sequence
  Synthetic
ITWYLSWSPCANCCRKILRFLRKHSNVNIDIHVARLYYIEDENIRQGLKSLVNLAVTIAVMEIEGKVF

SEQ ID NO: 435 - protein, 64 aa, Artificial Sequence
  Synthetic
ITWYLSWSPCADCCHKILNFLKKHSNVNIIIYVARLYYKEDEKIRQGLKNLVNLAITIAVMEIE

SEQ ID NO: 436 - protein, 64 aa, Artificial Sequence
  Synthetic
ITWYLSWSPCEECCCKILNFLKKHSNVSICIYVARLYHIEDEKIRQGLKNLVNFTVTVAVMGIE

SEQ ID NO: 437 - protein, 155 aa, Artificial Sequence
  Synthetic
FEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRL

SEQ ID NO: 438 - protein, 157 aa, Artificial Sequence
  Synthetic
FEVFFDPRELRKEACLLYEIQWGTSHKIWRNSGKNTTKHVELNFIEKFTSERHFCSSVSCSIIWFLSWSPCWECSKAIREFLSQRPTVTLVIFVSRLFQHMDQQNRQGLRDLINSGVTIQIMRASEYDHCWRNFVNYPPGKEAHWPRYPPLWMKLYA

SEQ ID NO: 439 - protein, 158 aa, Artificial Sequence
  Synthetic
IFDPRELRKEACLLYEIKWGTGHKIWRHSGKNTTRHVEVNFIEKITSERQFCSSTSCSIIWFLSWSPCWECSKAITEFLRQRPGVTLVIYVARLYHHMDEQNRQGLRDLVKSGVTVQIMTTPEYDYCWRNFVNYPPGKDTHCPIYPPLLMKLYALELH

SEQ ID NO: 440 - protein, 160 aa, Artificial Sequence
  Synthetic
FEAFFDPRELRKEACLLYEIKWGMSHNIWRYSGKNTTKHVEINFIEKFTSERHLRPSISCSIVWFLSWSPCWECSKAIREFLSQHPNVTLVIYVARLFQHMDRLNRQGLRDLINSGVTIQIMRTSEYDHCWRNFVNYPPGKEAHWPRYSLLWMKLYALEL

SEQ ID NO: 441 - protein, 152 aa, Artificial Sequence
  Synthetic
VFFDPRELRKETCLLYELQWGRSRDTWRHTGKNTTNHVERNFLAKITSERHFHPSVHCSIVWFLSWSPCWECSEAIREFLDQHPSVTLVIYVARLFQHMDPQNRQGLRDLVNHGVTIQIMGAPEYDYCWRNFVNYPPGKEAHWPRFPPVWMT

SEQ ID NO: 442 - protein, 153 aa, Artificial Sequence
  Synthetic
FDPRNFCKEAYLLYEIQWGNSRDVWRHSGKNTTKHVERNFIEKIASERHFRPSISCSISWYLSWSPCWECSKAIREFLNQHPNVTLVIYIARLFQHMDPQNRQGLKDLFHSGVTIQVMRDPEYDYCWRNFVNYPQGKEAHWPRYPPLWMNLYA

SEQ ID NO: 443 - protein, 155 aa, Artificial Sequence
  Synthetic
FEVFFDPRELRKEACLLYEIKWGTSHRIWRNSGRNTANHVELNFIEKFTSERHFCPSVSCSITWFLSWSPCWECSKAIRGFLSQHPSVTLVIYVSRLFWHLDQQNRQGLRDLVNSGVTVQIMRVPEYDHCWRNFVNYPPGEEDHWPRYPVVWMKL

SEQ ID NO: 444 - protein, 161 aa, Artificial Sequence
  Synthetic
FEGFFDPRELRKETCLLYEIQWGTSHKTWRNSGKNTTNHVEINFMEKFAAERQYCPSIRCSITWFLSWSPCWECSNAIRGFLSQHPSVTLVIYVARLFWHTDPQNRQGLRDLINSGVTIQIMTVPEYDHCWRNFVNYPPGKEDHWPRYPVLWMKLYALELH

SEQ ID NO: 445 - protein, 151 aa, Artificial Sequence
  Synthetic
FEVFFNPGVLRKETCLLYEIQWGTSRKIWRNSSKNTTNHVEVNFIEKFTAERHFCPSISCSITWFLSWSPCWECSKAIREFLSQHPNMTLVIYTARLFQHMDQQNRQGLRDLINSGVTIQMMTVSDSLTCWLHFLSHRVYVILMKKCGNLV

SEQ ID NO: 446 - protein, 152 aa, Artificial Sequence
  Synthetic
FEVFFDPQELRKEACLLYEIKWGASSKTWRSSGKNTTNHVEVNFLEKLTSEGRLGPSTCCSITWFLSWSPCWECSTAIREFLSQHPGVTLVIFVARLFQHMDRRNRQGLKDLVTSGVTVQVMSVSEYCYCWENFVNYPPGKAAQWPRYPPRW

SEQ ID NO: 447 - protein, 157 aa, Artificial Sequence
  Synthetic
FEASFDPRQLQKEACLLSEVRWGASPRTWRESGLNTTSHVEINFIEKFTSGRSLRPAIRCSVTWFLSWSPCWECARAIREFLHQHPNVSLVIYVARLYWHVDEQNRQGLRDLVTSGVRVQIMSDSEYSHCWRNFVNFPPGQEAGWPRFPPMWTTLYA

SEQ ID NO: 448 - protein, 157 aa, Artificial Sequence
  Synthetic
FEAYFDPRQLRKEACMLSEVRWGASPRTWRESSLNTTSHVEINFIEKFTSGRSLRPAVRCSMTWFLSWSPCWECARAIREFLHQHPNVSLVIYVARLYWHVDEQNRQGLRDLVTSGVRVQIMSDSEYRHCWRNFVNFPPGQEAGWPRFPPMWTTLYA

SEQ ID NO: 449 - protein, 155 aa, Artificial Sequence
  Synthetic
YISYDPKELCKETCLLYEIKWGMSWKIWRSSGKNTTNHVEINFIEKFTSERHFHLSVSCSITWFLSWSPCWECSQAIREFLSQHPGVTLVIYVARLFQHMDQQNRQGLRDLVNSGVTIQMMTVSEYYHCWRNFVNYPPGEEAHWPRHPPLWLMLY

SEQ ID NO: 450 - protein, 154 aa, Artificial Sequence
  Synthetic
DIFYDPRELRKEACLLYEIKWGMSPKIWRSSGKNTTNHVEVNFIEKLTSERRFHSSISCSITWFLSWSPCWECSQAIREFLSQHPGVTLVIYVARLFWHTDQQNRQGLRDLVNSGVTIQIMTASEYYHCWRNFVNYPPGEEAHWPRYPPLWMML

SEQ ID NO: 451 - protein, 154 aa, Artificial Sequence
  Synthetic
DVFYDPRELRKEACLLYEIKWGMSQKIWRSSGKNTTNHVEVNFIKKFTSEGRFQSSISCSITWFLSWSPCWECSQAIREFLSQHPGVTLVIYVARLFWHMDQQNRQGLRDLVNSGVTIQIMRASEYYHCWRNFVNYPPGDEAHWPRYPPLWMML

SEQ ID NO: 452 - protein, 155 aa, Artificial Sequence
  Synthetic
FDVFYDPRELRKEACLLYEIKWGMSRKIWRSSGKNTTNHVEVNFIKKFTSERHFHPSISCSITWFLSWSPCWECSQAIREFLSQHPGVTLVIYVARLFWHMDQQNRQGLRDLVNSGVTIQIMRASEYYHCWRNFVNYPPGDEAHWPQYPPLWMML

SEQ ID NO: 453 - protein, 98 aa, Artificial Sequence
  Synthetic
ERSLNPLTHCSVTWFLSWSPCWKCSQSVVEFRKAYPKVNLEIYVARLFRHEEECNRQGLRDLVMNGVTIRVMNLSAYNYCWRTFVSHQGDDYWPWHLT

SEQ ID NO: 454 - protein, 150 aa, Artificial Sequence
  Synthetic
FQENYMPSTWPKVTHLLYEIRWGKGSKVWRNWCSNTLTQHAEVNCLENAFGKLQFNPPVPCHITWFLSWSPCCQCCRRILQFLRAHSHITLVIKAAQLFKHMDERNRQGLRDLVQSGVHVQVMDLPDYRYCWRTFVSHPEGEGDFWPWFF

SEQ ID NO: 455 - protein, 134 aa, Artificial Sequence
  Synthetic
FQINYSPSQHRRGVYLLYEIRWRRGSIWRNWCSNTHRQHAEVNFLENCFKDRPQVPCSITWFLSASPCGKCSKRILEFLKSRPYVTLKIYAAKLFRHHDIRNREGLCNLGMHGVTIHIMNLEDYSYCWRNFVVY

SEQ ID NO: 456 - protein, 135 aa, Artificial Sequence
  Synthetic
FQRNYSPSQNGRVVYLLYEIRWKGGSIWRNWCSNNPEQHAEINFLENRFNDRPQTSCSITWFLSTSPCGKCSKRILEFLRSHPNVTLKIYTAKLFRHYEIRNRQGLRNLIMNGVAVHIMNLEDYSYCWTNFVAHQ

SEQ ID NO: 457 - protein, 134 aa, Artificial Sequence
  Synthetic
FQRNYSPRQHGRVVYLLYEIRWRRGSIWRNWCLNNHEQHAEVNFLENHFNDRPQTPCSITWFLSTSPCGKCSRRILDFLRSHPNVTLVIYAAKLFKHHDIRNRQGLRNLNMNGVTIRIMNVEDYRYCWRNFVAY

SEQ ID NO: 458 - protein, 134 aa, Artificial Sequence
  Synthetic
FKRNYLPGQHPQVVYLLYEIRWRNGSIWRNWFSNNRNQHAEVNFLENCFSDVPPAPCSITWFLSTSPCGKCSRRILEFLRTHRNVTLEIYAAKLFRHQDIRNRQGLCNLVMNGVTIHIMNLADYSYCWKRFVAY

SEQ ID NO: 459 - protein, 134 aa, Artificial Sequence
  Synthetic
FQRNYLPDQHPQAVYLLYEFRWRRGSIWRKWCSNNRAQHAEVNFLENCFNGIPPVPCSITWFLSTTPCGNCSRRILEFLRLHPNVTLEIYAAKLFRHTDIRNRKGLYNLAMNGVIIRIMNLADYSYCWRNFVAY

SEQ ID NO: 460 - protein, 119 aa, Artificial Sequence
  Synthetic
RNYLPGCYPKVVYLLYEIKWRRGTTWRNWCSNSRNLHAEVNFLENCFKAVPSVSCSMTWFLSAIPCGKCSRRILEFLKVYPNVTLEIYAAKLFKHLDIRNRQGLRNLAMNGVIIRIMNL

SEQ ID NO: 461 - protein, 134 aa, Artificial Sequence
  Synthetic
FKRNYQPGRRPNVVYLLYEIRWRRGTIWRNWCSNEFPQHAEDNFFQNRFNAVPSVSCSITWFLSTTPCGRCSKRILEFLRLHPNVTLKIYAARLFRHLDNRNRQGLRKLASNGVIIQIMGLPDYSYSWKKFVAY

SEQ ID NO: 462 - protein, 134 aa, Artificial Sequence
  Synthetic
FKTNYSPDHRPRVVYLLYEIRWRRGTIWRNWCSNNIDQHAEVNFLENCFKAKPSVSCSITWFLSTAPCAKCSRRILKFLTAHPKVTLEIYAAKLFRHLEIRNRQGLMDLAVNGVILRIMNLADYSYCWKQFVAY

SEQ ID NO: 463 - protein, 133 aa, Artificial Sequence
  Synthetic
KLNYVPVGRPRVVYLLYEIRWSRGSIWRNWCSNSSTQHAEVNFLENCFKAMPSVSCSITWFLSTTPCGNCSRRILEFLRAHPKVTLAIHAAKLFKHLDVRNRHGLKALATDGVVLHIMSIADYRYCWTKFVAY

SEQ ID NO: 464 - protein, 134 aa, Artificial Sequence
  Synthetic
FKRNYLPGQHPKVVYLLYEIRWSRGTIWRNWCSNNSTQHAEVNFLENCFKATPSVSCSITWVLSTTPCGKCSRRILEFLRVHPNVTLEIYAAKLFKHLDIRNRKGLRDLAMNGVIIRIMNLSDYSYCWKTFVAY

SEQ ID NO: 465 - protein, 134 aa, Artificial Sequence
  Synthetic
FKRNYLPGQHPEVVYLLYEIKWNSGTIWRNWCSNNPTQHAEVNFLENHFNVMSSVSCSITWGISTTPCGKCSRRILEFLTTHPNVTLEIYAAKLFKHLDIRNRQGLRNLAMNGVVICIMNLADYSYFWKTFVAY

SEQ ID NO: 466 - protein, 133 aa, Artificial Sequence
  Synthetic
IRNYLPDKHPNVVYLLYEIRWSRGTIWRNWCSNNSTQHAEVNFLENCFKAMPSVSCSITWFLSTTPCGRCSRRILKFLRVHPNVTLKIHAAKLFKHLDMRNRQGLKNLAMHGVIIRIMNLADYSYCWKTFVAH

SEQ ID NO: 467 - protein, 132 aa, Artificial Sequence
  Synthetic
RNYLPVQYPNMVYLLYEIRWSTGTIWRNWCSNNSTQHAEVNFLENRFNSRPSVSCSITWVLSTTPCGKCSTKILEFLRLHPNVTLKIYAAKLFKHLDIRNRQGLRNLAMNGVIIRIMNLADYSYCWKTFVAY

SEQ ID NO: 468 - protein, 134 aa, Artificial Sequence
  Synthetic
FKRNFLPGQHPKVVYLMYEIRWIRGTAWRSWCSNNSKQDAEVNLLENCFKAMPSVFCSVTWVLFTTPCGKCFRRILEFLRVHSNVALERYAAQLFRHLDICNWQGIRSLAMNGVIIHIMNLADYSYCWKRFVAY

SEQ ID NO: 469 - protein, 134 aa, Artificial Sequence
  Synthetic
FKRNYSPGQHPKVVYLLYEIRWSRGTTWRNWCSNNSTQHAEVNFLENCFKAMPSVFCSITWVLSTTPCGKCSRRIQEFLRVHPNVTLEIYAAKLFKHLDRRNRQGLRNLAMNGVIIRVMNLADYRYCWKRFVAY

SEQ ID NO: 470 - protein, 121 aa, Artificial Sequence
  Synthetic
FKINNLPGQHPRVVCLLYAIRWSRSTLWKSWCSNNSTQHAEVNFLENCFKGNPSVFCFMTWFFHTTPHGKCCRRTPEFLGVHPNVTLKIRAAKLFKHLDRYNQQGLRNVAMNGVVIRIINL

SEQ ID NO: 471 - protein, 134 aa, Artificial Sequence
  Synthetic
FKRNYLPAQHPKVVYLLYEIRWSRGTIWRNWCSNNSTQHAEVNFLENCFKAMPSVSCSITWFLSTTPCGKCSRRILTFLREHPNVTLEIYAAKLFKHLDVRNQQGLRNLDRNGVIIRIMNFADYSYCWKRFVAY

SEQ ID NO: 472 - protein, 134 aa, Artificial Sequence
  Synthetic
FKRNFLPSKYPKVVYLLYEIRWSSGTIWRSWCSNNSTQHAEVNFLENCFKAMPSVSCSITWVLPITPCGKCSKKILEFLSVHPNVTLEIYAAKLFRHLDIRNQQGLRNLAMNGVIIRIMNLADYSYSWKRFVAY

SEQ ID NO: 473 - protein, 134 aa, Artificial Sequence
  Synthetic
FKRNYLPGQHPKVVYLLYEIRWSRGTIWRSWCSNNSKQHAEVNFLENCFKARPSVSCSITWVLSTTPCGKCSRRILEFLRVHPNVTLEIYAAKLFKHLDIRNQQGLRNLAMNGVIIRIMNLADYSYCWKRFVAH

SEQ ID NO: 474 - protein, 134 aa, Artificial Sequence
  Synthetic
FKRNYMPSQYPKVVYLLYEIRWSRGTVWRNWCSNSFTQHAEVNFLENYFKPMPSVSCSITWVLSTTPCGKCSRRILEFLRVHPNVTLEIYAAKLFKHLDIRNRQGLRDLAMNGVTIRIMNLADYSFCWKRFVAY

SEQ ID NO: 475 - protein, 134 aa, Artificial Sequence
  Synthetic
FKRNYLPGQHPKVVYLLYEIRWSRGTIWRNWCSNNSTQHAEVNFLENCFKAMPSVSCSITWVLSTTPCGKCSRRILEFLRVHPNVTLEIYAAKLFKHLDIRNRQGLRNLAMNGVIIRIMNLADYSYGWKRFVAY

SEQ ID NO: 476 - protein, 134 aa, Artificial Sequence
  Synthetic
FKRNYSPCQHPKVVYLLYEIRWRRGAIWRSWCSNNSTQHAEVNFLENCFRAMPSASCSITWVLSTSPCGKCSRRILEFLRVHPNVTLEIYAARLFKHLDTRNRQGLRNLAMEGVVIRIMNLADYSYWWKRFVTY

SEQ ID NO: 477 - protein, 133 aa, Artificial Sequence
  Synthetic
RSNYLPCQHPRVVYLLYEIRWSRGTIWRNWCSNNSTQHAEVNFLENCFKAMPSVPCSITWVLSTTPCGKCSRRILEFLRVHPNVTLEIYAAKLFKHLDIRNRQGLRNLAKNGVVIRIMKLADYSYWWKRFVAY

SEQ ID NO: 478 - protein, 134 aa, Artificial Sequence
  Synthetic
FKRNYLPGQHPKVVYILYEIRWSRGTIWRNWCTNNSTQHAEVNFLENCFKAMPSVSCSITWVLSTTPCGKCSKRIQDFLRIYPNVTLEIHAAKLFKHLDTRNREGLRNLAKDGVIIHIMNLADYSYWWKRFVAY

SEQ ID NO: 479 - protein, 134 aa, Artificial Sequence
  Synthetic
FKRNYLPYQHPKVVCLLYEIRWNRGTIWRSWCSNNSTQHAEVNFLENCFKAKPSVSCSITWVLSTTPCGECSRRILDFLSVYPNVTLKIYAAKLFKHLDNRNRQGLWNLANNRVIIRIMNLEDYNYYWKRFVAY

SEQ ID NO: 480 - protein, 129 aa, Artificial Sequence
  Synthetic
FKRNYLPNRHPKVVCLLYEIRWSRGTIWRNWCSNSSTQHAEVNFLENCFKANPSVSCSITWVLSTTPCGKCSRRILDFLSGYPNVTLEIYAAKLFKHLDNRNRQGLWNLANNRVSIHIMNLAGSGKLLV

SEQ ID NO: 481 - protein, 133 aa, Artificial Sequence
  Synthetic
FKGNYLPDKHPRVVYLLYEIRWSRGTIWRNWCSNSSTQHAEINFLENCFKTSKTVSCSIIWVLSTTPCGKCSRRILEFLREHPNVTLEIHAAKLFKHLDTRNQQGLRDLAMKGVIIHIMNVADYSYWWKRFVA

SEQ ID NO: 482 - protein, 134 aa, Artificial Sequence
  Synthetic
FKRNYLPGKHPRVVYLLYEIRWSRGTIWRSWCSNNATQHAEINFLETCFLARTSVSCSITWVLSTTPCGKCSRRILEFLNAYPNVTLEIYAAKLFRHLDNRNRQGLRNLAMKGVRIHIMNLADYSYFWKIFVAY

SEQ ID NO: 483 - protein, 134 aa, Artificial Sequence
  Synthetic
FTRNYLPNQHPRVVYLLYEIRWRRGTIWRNWCSNNSTQHAEIKFLENCFNATTSVSCSIIWFLSTTPCGKCSTRILEFLRAHPNVTLEIYAAKLFKHHDNRNRRGLWNLAMNGVKLHIMNPADYSYCWKMFVAY

SEQ ID NO: 484 - protein, 160 aa, Artificial Sequence
  Synthetic
FHLQFNNLHRPCRRKTYLCYQLRLGSLCDQDYFQNKDLHAEIRFIKKIRSLDLDQSHNYEVTCYLTWSPCPDCAQELVALTRSHPHVRLTLFTSRLYFHWLWRFQEGLRLLWRSGVQIRVMSLREFTHCWVKFVNHGGCPFEPWDGLEQRSQSIQNRLNR

SEQ ID NO: 485 - protein, 151 aa, Artificial Sequence
  Synthetic
NRHRVRYQRKTYLCYLLEQNGQQPLKGCLQNKGKHAEILFIDEMRSLELGQVQITCYLTWSPCPNCAQELAAFKSDHPDLVLRIYTSRLYFHWRRKYQEGLCCLWRSGIQVDVMDLPQFADCWTNFVNQSPFWPWNNLEKNSRCIQRRLQR

SEQ ID NO: 486 - protein, 151 aa, Artificial Sequence
  Synthetic
NSHRVRYRRKSYLCYQLERNGQEPLKGYLLYKGQHVEILFLEKMRSMELSQVRITCYLTWSPCPNCARQLAAFKKDHPDLILRIYTSRLYFYWRKKFQKGLCTLWRSGIHVDVMDLPQFADCWTNFVNQRPFRPWNELEKNSWRIQRRLRR

SEQ ID NO: 487 - protein, 155 aa, Artificial Sequence
  Synthetic
FYSQFYNQRVHGVKPYLCYQLEQNGQAPLKGCLLSEGQHAEILFLDKIRSMELSQVIITCYLTWSPCPNCAWQLAAFKRDRPDLILHIYTSRLYFHWKRPFQKGLCSLWQSGILVDVMDLPQFTDCWTNFVNKRPFWPWKGLEIISRRTQRRLHR

SEQ ID NO: 488 - protein, 160 aa, Artificial Sequence
  Synthetic
FRIQFNNAYKPHRRVTYLCYQVQKNGNLLTKGCLRTKGYHAESRFIKRICSLGLDQAQSYQVTCFLTWSPCPRCAQELVLFKSSHPHLYLRIFTARLYFHWRKSYQEGLQRLCRAQVPVAVMGYPEFAHCWYNFVDHPGPFEPWYKMEYYSKCIKKRFQR

SEQ ID NO: 489 - protein, 160 aa, Artificial Sequence
  Synthetic
FRVQFNNAYKPRRRVTYLCYQLQENGDPLTKGCLRTKGYHAESRFIKRICSMDLGQDQSYQVTCFLTWSPCPHCAQELVSFKRAHPHLRLQIFTARLFFHWKRSYQEGLQRLCRAQVPVAVMGHPEFAYCWDNFVDHPGPFEPWAKLEYYSSCLKRRLQQ

SEQ ID NO: 490 - protein, 160 aa, Artificial Sequence
  Synthetic
FNKQFGNQPRPYRRKTYLCYQLKGNGSILAQGCVRNKQRHAEIRFIDKINFMNLNPNQSYEIICYVTWSPCPTCAEKLVDLINDQVHLKLQIFASRLYFHWVRKYQIGLQYLWASQVTVAVMNRQEFKDCWEKFVDNGKDFQGWYKLEEYNRSISRRLNR

SEQ ID NO: 491 - protein, 160 aa, Artificial Sequence
  Synthetic
FKQQFGNQPRPYRRKTYLCYQLKQNDLTLDRGCFRNKQRHAEIRFIDKINSLDLNPSQSYKIICYITWSPCPNCANELVNFITRNNHLKLEIFASRLYFHWIKSFKMGLQDLQNAGISVAVMTHTEFEDCWEQFVDNSRPFQPWDKLEQYSASIRRRLQR

SEQ ID NO: 492 - protein, 158 aa, Artificial Sequence
  Synthetic
NIQLTNPYPKRTYLCYQLMPNGSTPTRGYFKNKNRHAEICFIDEIESMGLDKTQCYEVTCYLTWSPCPSCAQKLVAFAKAQVHLNLRIFASRLYYHWLLSCKKGLQLLWKSQIPVEVMGLPEFTDCWENFVVHGPPPFNPSEKLQELGSRSIKRRLDK

SEQ ID NO: 493 - protein, 162 aa, Artificial Sequence
  Synthetic
FSLQFNNKRRPYPRKALLCYQLTPNGSTPTRGYLKNKKNHAEIRFINKIKSMGLDETQCYQVTCYLTWSPCPSCAGKLVDFLKAHRHLNLSIFASRLYYHWRPNYQEGLLLLCGSQVPVEVMGLPEFTDCWENFVDHEPPSFNPSEKLEELDSRAIKRRLER

SEQ ID NO: 494 - protein, 162 aa, Artificial Sequence
  Synthetic
FSLQFNNKHHPYRRKALLCYQLTPNGSTPTRGQLQNKKDHAEIRFINKIKSMGLDETQCYQVTCYLTWSPCPSCARELVDFIKAHNHLNLSIFASRLYYHWRPHYQEGLLLLCGSRVPVEVMGLPEFTDCWENFVDHKPPSFNPSEKLDELDSQAIKRRLER

SEQ ID NO: 495 - protein, 162 aa, Artificial Sequence
  Synthetic
FSLQFNNKRRPYPRKALLCYQLTPNGSTPTRGHLKNKKDHAEIRFINKIKSMGLDETQCYQVTCYLTWSPCPSCAGELVDFIKAHRHLNLRIFASRLYYHWRPNYQEGLLLLCGSQVPVEVMGLPEFTDCWENFVDHKPPSFNPSEKLKELDSQAIKRRLER

SEQ ID NO: 496 - protein, 162 aa, Artificial Sequence
  Synthetic
FRLQFNNKRRPYPRKALLCYQLTPNGSTPTRGYFKNKKRHAEIRFINKIKSMGLDETQCYQVTCYLTWSPCPSCAQELADFIKAHDHLNLRIFASRLYCHWCRRQQEGLRLLCGSQVPVEVMGFSEFADCWENFVDYEPLSFNPSEMLEELDSRAIKRRLEK

SEQ ID NO: 497 - protein, 162 aa, Artificial Sequence
  Synthetic
FSLQFNNKRRPYPRKALLCYQLTPNGSTPTRGYFKNKKCHAEIRFINEIKSMGLDETQCYQVTCYLTWSPCPSCVRELVAFIKAHDHLNLRIFASRLYCHWCRRQQEGLRLLCGSQVPVEVMGSREFADCWENFVDHKPLSFNPSEMLEELDSRAIKRRLER

SEQ ID NO: 498 - protein, 162 aa, Artificial Sequence
  Synthetic
FRLQFNNRRRPYPRKALLCYQLTPNGSTPTRGYFENKKCHAEICFINEIKSMGLDETQCYQVTCYLTWSPCSSCAWKLVDFIQAHDHLNLRIFASRLYYHWCKPQQEGLRLLCGSQVPVEVMGLPEFNDCWENFVDHEPLSFDPCKMLEELDSRAIKRRLER

SEQ ID NO: 499 - protein, 162 aa, Artificial Sequence
  Synthetic
FRLQFNNKRRPYPRKALLCYQLTPNGSTPTRGYFENKKCHAEICFINEIKSMGLDETQCYQVTCYLTWSPCSSCAWELVDFIKAHDHLNLGIFASRLYYHWCKPQQKGLRLLCGSQVPVEVMGFPEFADCWENFVDHEPLSFNPYKMLEELDSRAIKRRLER

SEQ ID NO: 500 - protein, 161 aa, Artificial Sequence
  Synthetic
FLYHFKNVRWAGRHETYLCYVVKRDSATSFLDFGYLRNKGCHVELIFLRYISAWDLDPSRCYRVTWFTSWSPCYDCARHVANFLRCYPNLTLRIFTARLYFCEDKKPEGLRRLHRAGVQIAIMTFKDYFYCWNTFVENERTFKAWEGLHENSVRLSRQLRR

SEQ ID NO: 501 - protein, 161 aa, Artificial Sequence
  Synthetic
FLYHFKNVRWAGRHETYLCFVVKRDSATSFLDFGYLRNKGCHVELLFLQYISAWDLDPSRCYRVTWFTSWSPCYDCARHVANFLRCYPNLSLRIFTARLYFCEDKKPEGLRRLHQAGVPIAIMTFKDYFYCWNTFVENERTFKAWEGLHENSVRLSRQLRR

SEQ ID NO: 502 - protein, 161 aa, Artificial Sequence
  Synthetic
FLYHFKNVRWAGRHETYLCYVVKRDSATSFLDFGHLRNKGCHVELLFLRYISDWDLDPGRCYRVTWFTSWSPCYDCARHVADFLRGYPNLSLRIFAARLYFCEDRKPEGLRRLHRAGVQIAIMTFKDYFYCWNTFVENERTFKAWEGLHENSVRLSRQLRR

SEQ ID NO: 503 - protein, 161 aa, Artificial Sequence
  Synthetic
FLYQFKNVRWAGRHETYLCYVVKRDSATSFLDFGHLRNKGCHVELLFLRYISDWDLDPGRCYRVTWFTSWSPCYDCARHVTDFLRGYPNLTLRIFTARLYFCEGRKPEGLRRLHRAGVQIAVMTFKDYFYCWNTFVANERTFEAWEGLHENSVRLTRQLRR

SEQ ID NO: 504 - protein, 120 aa, Artificial Sequence
  Synthetic
MYPLWGRHETYLCYVVKRDSATSFLDFGHLRNKGCHVELLFLRYISDWDLDPDRCYRVTWFTSWSPCYDCARHVADFLRGYPNLTLRIFTARLYFCEDQKPEGLRRLHRAGVQLAIMTFK

SEQ ID NO: 505 - protein, 162 aa, Artificial Sequence
  Synthetic
FIYQFKNVRWAGRHETYLCYVVKRDSPTSFLDFGHIRNKGCHVELLFLRYISDWDLDPGRCYRVTWFTSWSPCYDCARHVADFLRGYPNLSLRIFTARLYFCDKERKPEGLRQLHRAGVQIAIMTFKDYFYCWNTFVENERTFKAWEGLHENSVRLSRQLRR

SEQ ID NO: 506 - protein, 161 aa, Artificial Sequence
  Synthetic
FLYQFKNVRWAGRHETYLCYVVKRDSATSCLDFGHLRNKGCHVELLFLRYISDWDLDPGRCYRVTWFTSWSPCYDCARHVADFLRGNPNLSLRIFTARLYFCEDRKPEGLRRLHRAGVQIAVMTFKDYFYCWNTFVENEKTFKAWEGLHENSVRLSRQLRR

SEQ ID NO: 507 - protein, 151 aa, Artificial Sequence
  Synthetic
FLYQFKNVRWAGRRETYLCYVVKRDSATSFLDFGYLRNKGCHVELLFLRYISDWDLDPGRCYRVTWFTSWSPCYDCARHVADFLRGNPNLSLRIFTARLYFCEDRKPEGLRRLHRAGVQIAIMTFKENERTFKAWEGLHENSVRLSRQLRR

SEQ ID NO: 508 - protein, 161 aa, Artificial Sequence
  Synthetic
FLYQFKNVRWAGRRETYLCYVVKRDSATSFLDFGYLRNKGCHVELLFLRYISDWDLDPGRCYRVTWFTSWSPCYDCARHVADFLRGNPNLSLRIFTARLYFCEDRKPEGLRRLHRAGVQIAIMTFKDYFYCWNTFVENERTFKAWEGLHENSVRLSRQLRR

SEQ ID NO: 509 - protein, 149 aa, Artificial Sequence
  Synthetic
FLYHFKNVRWAGRHETYLCYVVKRDSATSFLDFGYLRNKGCHVELLFLRYISDWDLDPGRCYRVTWFTSWSPCYDCARHVADFLRGNPNLSLRIFTARLTGWGPAGLMSPARPSDYFYCWNTFVENERTFKAWEGLHENSVRLSRRLRR

SEQ ID NO: 510 - protein, 161 aa, Artificial Sequence
  Synthetic
FLYHFKNVRWAGRHETYLCYVVKRDSATSFLDFGHLRNQGCHVELLFLRYISDWDLDPGRCYRVTWFTSWSPCYDCARHVADFLRGNPNLSLRIFTARLYFCDGFKPEGLRRLHRAGVQIAIMTFKDYFYCWNTFVENEKTFKAWEGLHENSVRLSRQLRR

SEQ ID NO: 511 - protein, 161 aa, Artificial Sequence
  Synthetic
FLYQFKNVRWAGRHETYLCYVVKRDSATSFLDFGHLRNKGCHVELLFLRYISDWDLDPGRCYRVTWFTSWSPCYDCARHVANFLRGNPNLSLRIFTARLYFCDGYKPEGLRRLHRAGVQIAIMTFKDYFYCWNTFVENERSFKAWEGLHENSVRLTRQLRR

SEQ ID NO: 512 - protein, 161 aa, Artificial Sequence
  Synthetic
FLYHFKNVRWAGRHETYLCYVVKRDSATSFLDFGHLRNKGCHVELLFLRYISDWDLDPGRCYRVTWFTSWSPCYDCARHVADFLRGNPNLSLRIFTARLYFCEDYKPEGLRRLHRAGAQIAIMTFKDYFYCWNTFVENERTFRAWEGLHENSVRLSRQLRR

SEQ ID NO: 513 - protein, 161 aa, Artificial Sequence
  Synthetic
FLYHFKNVRWAGRHETYLCYVVKRDSATSFLDFGYLRNTGCHVELLFLRYISDWDLDPGRCYRVTWFTSWSPCYDCARHVADFLRGNPNLTLRIFTARLYFCEDRKPEGLRRLHQAGVQLGIMTFKDYFYCWNTFVENERTFKAWEGLHENSVRLSRQLRR

SEQ ID NO: 514 - protein, 161 aa, Artificial Sequence
  Synthetic
FLYHFKNVRWAGRHETYLCYVVKRDSATSFLDFGHLRNKGCHVELLFLRYISDWDLDPGRCYRVTWFTSWSPCYDCARHVAEFLRWNPNLSLRIFTARLYFCEDRKPEGLRRLHRAGVQIGIMTFKDYFYCWNTFVENERTFKAWEGLHENSVRLTRQLRR

SEQ ID NO: 515 - protein, 161 aa, Artificial Sequence
  Synthetic
FLYHFKNLRWAGRHETYLCYVVKQNSATSCLDFGYLRNKGCHVEVLFLRYISTWDLDPRHCYRITWFTSWSPCYDCARHVADFLSAYPNLSLRIFAARLYFCEERNPEGLRRLHRAGAQIAIMTFKDYFYCWNTFVENKTTFKAWEGLHENSVRLARRLRR

SEQ ID NO: 516 - protein, 162 aa, Artificial Sequence
  Synthetic
FLYHYKNLRWAGRHETYLCYIVKRYSSVSCLDFGYLRNRGCHAEMLFLRYLSVWVGHDPHRAYRVTWFSSWSPCYDCAKRTLEFLKGHPNFSLRIFSARLYFCEERNPEGLRKLQKAGVRLAVMSYKDYFYCWNTFVESERRFEAWDGLHENSVRLARKLRR

SEQ ID NO: 517 - protein, 124 aa, Artificial Sequence
  Synthetic
FLYHYKNVRWAGRHETYLCYIVKRYNPASYLDFGFLRNKGCHVEMLFLRFLTGWNIDPTLPYSVTWFTSWSPCYDCSQHVTHFLRVYPNLRLRIFTARLYFCEENNPEGLRNLHMAGVQLGVMT

SEQ ID NO: 518 - protein, 160 aa, Artificial Sequence
  Synthetic
FIYHYKNVRWAGRHETYLCFVVKRDGPDTLFDFGHLRNRGCHVELVFLRHLGALCPGLSYSVTWFCSWSPCYNCSRRLAHFLTRTPNLKLRIFCSRLYFCDVEDSSEGLRLLKRAGVQLSVMTYKDYFYCWQTFVARERGFKAWEGLHQNSVRLARKLNR

SEQ ID NO: 519 - protein, 160 aa, Artificial Sequence
  Synthetic
FIFHYKNVRWAGRHETYLCFVVKRIGPDSLFDFGHLRNRGCHVELLFLRHLGALCPGLCYSVTWFCSWSPCSKCAQQLAHFLSQTPNLRLRIFVSRLYFCDEEDSREGLRHLKRAGVQISVMTYKDFFYCWQTFVARERSFKAWDGLHENSVRLVRKLNQ

SEQ ID NO: 520 - protein, 160 aa, Artificial Sequence
  Synthetic
FLYHYKNVRWAGRNETYLCFVVKRVGPDSLFDFGHLRNRGCHVELLFLRQLGTLCPGLSYSITWFCSWSPCANCSSRLAQFLKQTPNLRLRIFVSRLYFCDMEDSREGLRLLKKVGVHITVMSYKDFFYCWENFVAQQSKFKAWEGLHQNTVRLARKLNR

SEQ ID NO: 521 - protein, 160 aa, Artificial Sequence
  Synthetic
FIFHYKNVRWAGRHETYLCFVVKRVGPDTLFDFGHLRNRGCHVELLFLRYLGALCPGLSYSVTWFCSWSPCADCSFRLSQFLNRTPNLRLRIFVSRLYFCDMENSREGLRMLKNAGAHITVMSYKDFFYCWQTFVARESNFKAWDELHRNSVRLSRKLHR

SEQ ID NO: 522 - protein, 160 aa, Artificial Sequence
  Synthetic
FIYHYKNVRWAGRHETYLCFVVKRVGPDTLFDFGHLRNRGCHVELLFLRYLGALCPGLSYSVTWFCSWSPCVNCSIQLCQFLNNTPNLRLRIFVSRLYFCDLEDSREGLRMLTKAGVRISVMSYKDYFYCWQKFVDCKSNFKAWEELHQNSVRLTRKLNR

SEQ ID NO: 523 - protein, 160 aa, Artificial Sequence
  Synthetic
FIYHYTNMRWAGRHETYLCFVVKRVGPDSLFDFGHLRNRGCHVELLFLRHLGALCPGFSYSITWFCSWSPCVNCSISLSQFLSRTPNLRLRIFVSRLYFCDMENSRDGLRMLKKAGVQVTVMSYKDFFYCWQTFVDRQSQFKAWKELHQNSVRLSRKLKR

SEQ ID NO: 524 - protein, 160 aa, Artificial Sequence
  Synthetic
FIYHYKNVRWAGRHETYLCFVVKRIGPNSLFDFGHLRNRGCHVELSEIQSFSAFCPALVQNDSKSCRISTDSESLHQIETSLDKTPKTGIKVFLSLSLFVTLANHSHYPQMASDLCLCVPIFLFTDFFYCWQTFVARESRFKAWDGLHQNSVRLSRKLKR

SEQ ID NO: 525 - protein, 160 aa, Artificial Sequence
  Synthetic
FIYHYKNMRWAGRHETYLCFVVKRVGPESLFDFGHLRNRGCHVELLFLRHLSALCPGLSYSITWFCSWSPCANCSFRLAQFLSQTPNLRLRIFVSRLYFCDLEDSREGLRMLKKVGVHITVMSYKDYFYCWQTFVARQSKFKPWDGLHQNSVRLSRKLNR

SEQ ID NO: 526 - protein, 160 aa, Artificial Sequence
  Synthetic
FIYHYKNLRWAGRCETYLCFVVKKVGPDSLFDFGHLRNRNCHVELLFLRHLGALCPGLSYSVTWFCSWSPCANCSIRLAQFLHQTPNLRLRIFVSRLYFCDLEDSREGLRILKKAGVHITVMSYKDYFYCWQTFVAKQSKFKPWDGLHQNYIRLSRKLNR

SEQ ID NO: 527 - protein, 161 aa, Artificial Sequence
  Synthetic
FIYHYKNLRWAGRCETYLCFVVKKVGRNRLFDLNVTMNNKPLHLQLLFLRHLGALCPGLSYSVTWFCSWSPCANCSIRLAQFLHQTPNLRLRIFVSRLYFCDLEDSREGLRILKKAGVHITVMSYKDYFYCWQTFVAKQSKFKPWDGLHQNYIRLSRKLNR

SEQ ID NO: 528 - protein, 161 aa, Artificial Sequence
  Synthetic
FLYNFKNLRWAGRHETYLCYVVKRDSATSFLDFGYLRNKGCHVEMLFLRYISAWDLDPGRCYRVTWFTSWSPCYDCARHVADFLRAYPNLTLRIFAARLYFCEDRNPEGLRRLHRAGVQIAIMTFKDYFYCWNTFVENERTFKAWEGLHENSVRLSRRLRR

SEQ ID NO: 529 - protein, 161 aa, Artificial Sequence
  Synthetic
FLYNFKNLRWAGRHETYMCYVVKRDSATSCLDFGYLRNKGCHVEVLFLRYISAWDLDPGRCYRVTWFTSWSPCYDCARHVADFLRAYPNLTLRIFVARLYFCEGRNPEGLRRLHRAGAHIAIMTFKDYFYCWNTFVENERTFKAWEGLHENSVHLTRKLRR

SEQ ID NO: 530 - protein, 161 aa, Artificial Sequence
  Synthetic
FLYNFKNLRWAGRRETYLCYVVKRDSATSCMDFGYLRNKGCHVELLFLRYISAWDLDPGRCYRITWFTSWSPCYDCARHVADFLRAYPNLTLRIFAARLYFCEDRKPEGLRRLHRAGAQIAIMTFKDYFYCWNTFVENEKTFEAWEGLHENSVHLTRKLRR

SEQ ID NO: 531 - protein, 161 aa, Artificial Sequence
  Synthetic
FLYNFKNLRWAGRRETYLCYVVKRDSATSCLDFGYLRNKGCHVEVLFLRYISAWDLDPGRCYRITWFTSWSPCYDCARHVADFLRTYPNLTLRIFAARLYFCEDRKPEGLRRLHKAGAQIAIMTFKDYFYCWNTFVENEKTFKAWEGLHENSVHLSRKLRR

SEQ ID NO: 532 - protein, 161 aa, Artificial Sequence
  Synthetic
FLYNFKNMRWAGRRETYLCYVVKRNSATSCLDFGYLRNQGCHVEVLFLRYISAWDLDPGRCYRITWFTSWSPCYDCARHVADFLRAYPNLSLRIFTARLYFCEDRKPEGLRRLHRAGAQIAIMTFKDYFYCWNTFVENEKTFKAWEGLHENSVRLSRQLRR

SEQ ID NO: 533 - protein, 161 aa, Artificial Sequence
  Synthetic
FLYNFKNLRWAGRRETYLCYVVKRDSATSCLDFGYLRNQGCHVEVLFLRYISAWDLDPGRCYRITWFTSWSPCYDCARHVANFLRAYPNLTLRIFTARLYFCEDRKPEGLRRLHRAGAQIAIMTFKDYFYCWNTFVENEKTFKAWEGLHENSVHLSRKLRR

SEQ ID NO: 534 - protein, 161 aa, Artificial Sequence
  Synthetic
FLYNFKNLRWAGRRETYLCYVVKRDSATSYLDFGYLRNQGCHVEVLFLRYISAWDLDPGRCYRITWFTSWSPCYDCARHVANFLHSYPNLTLRIFTARLYFCEDRKPEGLRRLHKAGAQIAIMTFKDYFYCWNTFVENEQTFKGWEGLRENSVHLSRKLRR

SEQ ID NO: 535 - protein, 161 aa, Artificial Sequence
  Synthetic
FLYNFKNLRWAGRRETYLCYVVKRDSATSCLDFGYLRNQGCHVEVLFLRYIAAWDLDPGRCYRITWFTSWSPCYDCAQHVANFLRSYPNLTLRIFTARLYFCEDRKPEGLRRLHKAGAQIAIMTFKDFFYCWNTFVENEQTFKGWEGLHENSVHLSRKLRR

SEQ ID NO: 536 - protein, 161 aa, Artificial Sequence
  Synthetic
FLYNFRNLRKAGRRETYLCYVVKRDSATSCLDFGYLRNQGCHVEVLFLRYIAAWDLDPGRCYRITWFTSWSPCYDCAQHIANFLRSYPNLTLRIFMARLYFCEDRKPEGLRRLHKAGAQIAIMTFKDYFYCWNTFVENEQTFKGWEGLHENSVHLARKLRR

SEQ ID NO: 537 - protein, 157 aa, Artificial Sequence
  Synthetic
FTHNFSNHKRTHKTYLCYEVEIHGDSGIPDKGFLCNKCHVELYLLGRIRSWKLDRKLHCRLTCFISWTPCGTCARELAEFLKENSHVSLCIFASRIYSLNDYEAGLRTLQEAGAQIAIMTFKEFRHCWETFVDHGRPFQPWDELDINSQGLSKELQA

SEQ ID NO: 538 - protein, 157 aa, Artificial Sequence
  Synthetic
FTQNFRNDNPSKTYLCYQVELDGSSGVLDKGSAFPGGQHAEWFLLEHIRSRNLDQKLSYKVTCFLSWTPCEKCAEEIIRFLAKNRHVSLSILASRIYTMGPYVKGLRELYDAGVHISIMTFRDFEYCWQTFVDHDSPFQPWADLDRRSQQLSQQLRA

SEQ ID NO: 539 - protein, 161 aa, Artificial Sequence
  Synthetic
FTSNFTNNPAIGRRQTYLCHEVQLDGDSWVLDRGFLQSQPLHAEFCFLDRVGSWQLNPNWHYRVTCFISWSPCFSCAQKVAMFLRRNSHVKLRILAARIYDYHPGYEEGLKALQGTGAQVAIMTHAEFEHCWDTFVDHGRPFQPWEGLDKNSQALSRRLQD

SEQ ID NO: 540 - protein, 161 aa, Artificial Sequence
  Synthetic
FRFNFINDASVGQKQTYLCYEVELDGNSWVLDRGFLLNQRRHAELCFLDRVSSWHLDPTKHYKFTWFLSWSPCRNCAQEVVAFLGGNSHVSLSIFAPRIYDYYSGYEEGLRSLQGAGAHVSIMTSTEFEHCWRTFVDNGCPFVPWNRLGENSQTISRRLQS

SEQ ID NO: 541 - protein, 153 aa, Artificial Sequence
  Synthetic
FQLNFINDLSVGQKQAYLCYEVELDCNSRVLNRGFLCNQGCHAELCFLDQVPSWQLDLVLCYRVTWFISWSPGPDCAQEVAAFLRGNSHVSLSIFASCIYDSVEESEGGWKGKKDLGASKKKFGHCWKTIVDNGRFFEPWNRLDESFDFLDLT

SEQ ID NO: 542 - protein, 150 aa, Artificial Sequence
  Synthetic
FMDHFANEDGGGLNETYLCYEVQLDGSSQGFLRNKRRHAELCFLDLVPAWRLDPAQHYRVTWFISWSPCFLCAQAVAEFLRRNAHVSLRIFAARIYTWRTDYKAGLQDLQRAGAQIAIMTPAEIQFCWNTFVDNSNPFHSHLGLGHAKPA

SEQ ID NO: 543 - protein, 113 aa, Artificial Sequence
  Synthetic
CFDGNNRRPRAELCFLALFQSWHLNEGKQYRLTWYSSWSPYPDCVPKLVEFLGDNSNVSLRIFAAGIHSIFTGYKRELRNLRDAGAQLAIMTLEELRWELGGEMATWRWQNEN

SEQ ID NO: 544 - protein, 158 aa, Artificial Sequence
  Synthetic
FKENFANTWENETELCYEVEVEGDTWAVEQGFLCNQPCHAELCFLCLVRSWHVDEGKQYRLTWHISWSPCPNCAQKLVKFLHDNSHVSLRIFAAGIQTTFSGHEDWLRKLRDSGAQLAIMTLKELQHCWDTFVDNGQPFEPWPNLVEHIQTESQKLKD

SEQ ID NO: 545 - protein, 156 aa, Artificial Sequence
  Synthetic
EWNFGITWAKETYLCYEVEVEGDAWVAKEGFLRNELRHAELCFLRGVSDWDLDEGKQYRLTYMSWSPCPNCAPKLVEFLDENSHVTLRIFPARIHTKSRGYQDGLRNLRDAGAQLAIMTLKEHQHCWDTFVDNGQPFRPWPNLVEHIETKSQELKD

SEQ ID NO: 546 - protein, 157 aa, Artificial Sequence
  Synthetic
FKDNFGHNWEKTYLWYEVEFEGDAWAVEQGFLRNQLRHAELCFLHGVRSWHLDEGKQYRLTWHISWSPCPDCASKLVEFLGENSHVSLRIFAARIHTKYRGYEDGLRQLQDAVDHLTIMTLKELQHCWVTFVDNGQPFEPEIELLENIGAQCQKLES

SEQ ID NO: 547 - protein, 158 aa, Artificial Sequence
  Synthetic
FKDNFGITWANETYLCYEVEVEGDAWAVEQGFLRNQRSHAELCFLDRVPSWHLDEGKQYRLTCYISWSPCPDCAQKLVEFMGENSHVSLRIFAARIYTKLDGHEDGLRKLQDAGAQLAIMTLKEYEHCWDTFVDSGQLFRARDELEVHIGAQCQRLEN

SEQ ID NO: 548 - protein, 153 aa, Artificial Sequence
  Synthetic
FKRNFRNKCKNQTYLCYEVEVEGNAWAVEQGFLRNQRRHAELCFLDRVPCWNLDGLKKYRLTCYISWSPCPDCALELVQFLGLKSNVSLRMCTAGIRTTFPGHEDGLRNLRDAGAQLTIMTRDEYEHCWDTFVDNGQPFRARDELEGHDYFLL

SEQ ID NO: 549 - protein, 157 aa, Artificial Sequence
  Synthetic
EVNFGHDWEKKTYLCYEVEVEGDAWVGKQGFLCNQPGHAELCFLDRVRSWHLDGGKQYRLTCYMSWTPSPDCALELVQFLSENSHVSLRIFAAGIRTRFHGHEDGLRQLRDAGAQLAIMTLHELQHCWDTFVDNGQPFRARDELEVHIGAQCQKLKS

SEQ ID NO: 550 - protein, 158 aa, Artificial Sequence
  Synthetic
KRRNFRNKCENQTYLCYEVEVKDGKWTVEQGFLRNQPGHAELCFLDRVRSWHLDEGRQYRLTCYISWTPGPDCAQKLVEFLGENRHVSLRIFAAGIHTKYRGHEDGLRQLWDAGAQIAIMTLNELQHCWETFVDNGQPFEPWPIQVEHIQTESQKLKD

SEQ ID NO: 551 - protein, 131 aa, Artificial Sequence
  Synthetic
AEKLFFKKLLQQVYYCFGLKIEGRDQPRHAELCFQDRVRSWHLDEGKQYRLTCYISWSPCPDCAQKLVEFLGENSHVRLRIFAARIYKKRDRYKHWLRQLRDAGAQLTIMTLNELQHCWVTFVDNGQRFEP

SEQ ID NO: 552 - protein, 120 aa, Artificial Sequence
  Synthetic
FRVNFSYYRERKTYLCYEVEVEGDAWVVKQDFLRNQPRHAELCFLDGVRSWHLDEGKQYRLTCYISWSPCPVCAQELVEFLGENRHLRLRIFAARIYSIVSGYEDGLRQLWDAGAPLAIM

SEQ ID NO: 553 - protein, 158 aa, Artificial Sequence
  Synthetic
FKDNFSHRRARRTYLCYQVEVEGDAWAVEYGFLCNQLRHAELCFLDRVPFWNLEEGRQYRLTCYISWSPCPDCAQRLVEFLGNNNHMRLRIFAARIYTFVSGHEDGLRQLWDAGAQLTIMTRNDLQHCWDTFVDNGDPFEPCPIQVEHIGTESQELEN

SEQ ID NO: 554 - protein, 158 aa, Artificial Sequence
  Synthetic
FKENFSHRRARKTYLCYEVEVEGNTWAVEQGFLHNQLRHAELCFLDRVRFWNLEEGRQYRLTCYISWSPCPDCAQKLVEFLGQNSHVSLCIFAARIYTIVSGYKDGLCQLRDAGAQLTIMTLNDLQHCWENLVDNGEPFEPCPTLVEHIETKSQELKD

SEQ ID NO: 555 - protein, 163 aa, Artificial Sequence
  Synthetic
FTFNFNNDLSVGRHQTYLCYEVERDNGTWVMDRGFLHNKGCHAELCFLGEVPSWQLDPAQTYRVTWFISWSPCLRRGCAEQVRAFLQENTHVRLHIFAARIYDFDFLYQEALRTLRDAGAQVSIMTYEEFKHCWDTFVDHGRPFQRWDGLDEHSQDLSGRLRA

SEQ ID NO: 556 - protein, 163 aa, Artificial Sequence
  Synthetic
FTINFNNDLSVGRRQTYLCYEVERDNGTWVMDWGFLCNQSCHVELCFLSQVSSWQLDPAQTYRVTWFISWSPCFSGGCAEQVRAFLQENTHVRLCIFAARIYNYDPLYQEALRMLRDAGAQVSIMTYEEFEYCWDTFVDRGCPFQPWDGLDEHSQALSGRLRA

SEQ ID NO: 557 - protein, 163 aa, Artificial Sequence
  Synthetic
FTSNFNNDVSVGRHQTYLCYEVERDNGTWVMDWGFLCNQGCHAELCFLGWVPSWQLDPAQTYRVTWFISWSPCFSWGCAEQVRAFLQENTHVRLHIFAARIYDYDPLYQEALRTLRDAGAQVSIMTYDEFEYCWDTFVDCGCPFQPWDGLDEHSQALSERLRA

SEQ ID NO: 558 - protein, 163 aa, Artificial Sequence
  Synthetic
FTFNFNNDPLVGRHQTYLCYEVERDNGTWVMDRGFLHNQGRHTELCFLGLIPYWQLDLAQTYRVTWFISWSPCFSWGCAEQVRAFLQENTHMRLRIFAARIYDYDPLYKEALQMLRGAGAQVSIMTYDEFEHCWDTFVDHGRPFQPWDGLEEHSQALSGRLQA

SEQ ID NO: 559 - protein, 163 aa, Artificial Sequence
  Synthetic
FTFNFNNDPFVRRHQTYLCYEVEHDNGTWVMDRGSLHNQGRHAELRFLGLLPYWQLDPAQIYRVTWFISWSPCFSWGCARQVRAFLQENTHVRLRIFAARIYDYDPLYKEALQMLRDAGAQVSIMTYDEFEYCWNTFVDHGCPFQPWDGLEEHSQALSGKLQA

SEQ ID NO: 560 - protein, 160 aa, Artificial Sequence
  Synthetic
FTSNFNNGRWHKTYLCYEVERDNGTWVMDRGFLHNQGRHAELCFLDLVPSLQLDPAQTYRVTWFISWSPCFSWGCAEQVRAFLQENTHVRLRLFAARIYDYDPLYKEALQMLRGAGAQVSIMTYHEFKHCWDTFVDHGRPFQPWDGLEEHSQALSGRLQA

SEQ ID NO: 561 - protein, 160 aa, Artificial Sequence
  Synthetic
FTSNFNNGGRRKTYLCYEVERDNGTSVMDRGFLHNQGRHAELRFLDLVPSLQLDPAQIYRVTWFISWSPCFSWGCAGQVRAFLQENTHVRLRIFAARIYDYDPLYKEALQMLRDAGAQVSIMTYDEFKHCWDTFVDHGCPFQPWDGLEEHSQALSGRLRA

SEQ ID NO: 562 - protein, 163 aa, Artificial Sequence
  Synthetic
FTSNFNNDLLVRRHQTYLCYEVERDNGTWVMDRGFLHNQGRHAELRFLDLVPSLQLDPAQIYRVTWFISWSPCFSWGCAGQVCEFLQENTHMRLRIFAARIYDYDPLYKKALQMLRDAGAQVSIMTYDEFKHCWDTFVYRGCPFQPWDGLEEHSQALSGRLQA

SEQ ID NO: 563 - protein, 163 aa, Artificial Sequence
  Synthetic
FTFNFNNDPLVRRHQTYLCYEVERDNGTWVMDMGFLCNEGRHAELRFLDLVPSLQLDPAQIYRVTWFISWSPCFSWGCAGQVRAFLQENTHVRLRIFAARIYDYDPLYKEALQMLRDAGAQVSIMTYDEFEYCWDTFVYRGCPFQPWDGLEEHSQALSGRLRA

SEQ ID NO: 564 - protein, 163 aa, Artificial Sequence
  Synthetic
FTFNFNNDPLVRRHQTYLCYEVERDNGTWVMDMGFLCNEGRHAELRFLDLVPSLQLDPAQIYRVTWFISWSPCFSWGCAGQVCEFLQENTHMRLRIFAARIYDYDPLYKKALQMLRDAGAQVSIMTYDEFKHCWDTFVYRGCPFQPWDGLEEHSQALSGRLQA

SEQ ID NO: 565 - protein, 157 aa, Artificial Sequence
  Synthetic
FTYNFTNDPSVGQHQTYLCYKVECDNDTWVLDKGILPNQHAEQYFLYLISFWKLDQAQCYRVTWFISWSTCFSCAQQVATFHWENRCVSLHIFIARIYNYLPGYEGLCMLQRAGTQISIMTSKFRHCWVTFVDHGHPFQPWDGLDEHSQALSGRLQA

SEQ ID NO: 566 - protein, 157 aa, Artificial Sequence
  Synthetic
FTYNFTNDPSVGQHQTYLCYKVECDNDTWVLDKGILPNQHAEQYFLYLISFWKLDRAQCYRVTWFISWSTCFSCAQQVTTFHWENRCVSLHIFVACIYNYLPGYEGLCMLQRAGTQISIMTSGFRHCWVTFVDHGHPFQPWDGLDEHSQALSGRLQA

SEQ ID NO: 567 - protein, 126 aa, Artificial Sequence
  Synthetic
FTYNFTNDPSVGRHQTYLCYEVEHHNGTWVLHRGFILNEGRHAELCLLDLILFWKLDLAQRYRVTCFISWSPCFCCAEKVAEFLQENPHVNLRIFAARIYGYQRGYKKGLRRLNRAGAPISMMKYS

SEQ ID NO: 568 - protein, 161 aa, Artificial Sequence
  Synthetic
FTYNFTNDPSVGQHQTYLCYEVEHHNGTWVLHRGFILNQGRHAELCLLDLISFWKLDLAQYYTVTCFISWSPCFSCAEKVAEFLQENPHVNLHIFAAHIYGYQRGYIKGLCRLNRAGAPISMMKYSEFSYCWDTFVDHEHPFQPWEGLDEYTQALSGKLQA

SEQ ID NO: 569 - protein, 149 aa, Artificial Sequence
  Synthetic
  misc_feature (139)..(142): Xaa can be any naturally occurring amino acid
FTSNFNNKPWVGQRETYLCYKVERHNDTWVLNRGFLRNQGRHAELCFLDLIPFWKLDDQQYRVTCFTSWSPCFSCAQKMAKFISKNKHVSLCIFAARIYDDQGRCQEGLRTLHRDGAKIAVMNYSEFEYCWDTFVDRGXXXXLGVKPDC

SEQ ID NO: 570 - protein, 160 aa, Artificial Sequence
  Synthetic
FTSNFYNKPWVGQHETYLCYKVERHNGTWVLNRGFLRNQGRHAELCFLDLIPFWKLDGQQYRVTCFTSWSPCFSCAQEMAKFISNNEHVSLCIFAARIYDDQGRCQEGLRTLHRDGAKIAMMNYSEFEYCWDTFVDRGRPFQPWDGLDEHSQDLSGRLRA

SEQ ID NO: 571 - protein, 160 aa, Artificial Sequence
  Synthetic
FTSNFNNKPWVGQHETYLCYKVERHNDTWVLNRGFLRNQGRHAELCFLDLIPFWKLDGQQYRVTCFTSWSPCFSCAQEMAKFISNNEHVSLCIFAARIYDDQGRYQEGLRALHRDGAKIAMMNYSEFEYCWDTFVDRGRPFQPWDGLDEHSQALSGRLRA

SEQ ID NO: 572 - protein, 161 aa, Artificial Sequence
  Synthetic
FTSNFNNEPCVGRHETYLCYKVERHNDTWVLNRGFLCNQGRHAELCFLDVIPFWKLDGKQRYRVTCFTSWSPCFRCAQEMAKFISNNQHVSLCIFAARIYDDQGRCKEGLRTLDEAEAKISIMTYSEFQHCWDTFVDHGRPFQPWDGLEEHSEAWSGKLQA

SEQ ID NO: 573 - protein, 161 aa, Artificial Sequence
  Synthetic
FTSNFNNEHWVGRHETYLCYEVERHNDTWVLNRGFLCNQGRHAELCFLDVIPFWKLDLHQDYRVTCFTSWSPCFSCAQEMAKFISNKKHVSLCIFAARIYDDQGRCQEGLRTLAEAGAKISIMTYSEFKHCWDTFVYHGCPFQPWDGLEEHSQALSGRLQA

SEQ ID NO: 574 - protein, 159 aa, Artificial Sequence
  Synthetic
FTSNFNNEHWVGRHETYLCYEVERHNDTWVLNRGFLCNQGRHAELCFLDVIPFWKLDLHQDYRVTCFTSWSPCFSCAQEMAKFISNKKHVSLCIFAARIYDDQGRCQEGLRTLAEAGAKISIMTYSEFKHCWDTFVDHGCPFQPWDGLEEHSQSLGDRA

SEQ ID NO: 575 - protein, 164 aa, Artificial Sequence
  Synthetic
FNFHYKNLQRAGRRKTYLCYLLEEEREGAIVLDVGVLHNQEHAERRFLSSPDILQLLDGGRRYRVTWYLSWSPCSQCARAVAGFLAQHGNVSLRIFVARLYNHEDPENRQGLRTLNSTGTPIRVMTNREFALCWERFVRHQGAAFEPWAGLRENADLLLGQLED

SEQ ID NO: 576 - protein, 159 aa, Artificial Sequence
  Synthetic
FMFQFKNVEYSGRNKTILCYTVERPEGQVFHGYLEDESAHAEDAFFTSVLPQLTSGSVTVTCYVSSSPCVNCAASVAQCLRRNKTVRIQLAVARLFQWEEPEIRRALKGLRSAGCQVRMMRGADYVYVWKNFVEPDHQDFIPWEDLEENARYYEEKLEE

SEQ ID NO: 577 - protein, 160 aa, Artificial Sequence
  Synthetic
FKFQFKNVEYSGRNKTFLCFLVDVQGSGGEGLRGYLEDEGAHAEEAFFQQVLPQDSALHYMVTWYVSSSPCAACTAKLVEILKARKTMRLTIFSARLFMWEEPEIQVGLKALAAAGCKLRMMKPTDFVYIWDTFVENDQTFTPWEDCQENYEYYQEKLAD

SEQ ID NO: 578 - protein, 160 aa, Artificial Sequence
  Synthetic
FKFQFKNVEYSGRNKTFLCYQVDIQGGETDGVRGYLEDEGSHAEEAFFQQVLAYDKSLRYTVTWYTSSSPCVACAAKLVEILKARKALRLNIHCSRLFEWEEPEIQAGLQALVRAGCKLRMMRPVDFVYVWSTFVENEDNFTPWEDCQDNFEYYDERLQD

SEQ ID NO: 579 - protein, 159 aa, Artificial Sequence
  Synthetic
FKFQFRNVEYSGRNKTLLCFRVDTAGGSTEPLRGYMEDETAHAEEAFFQQVLPNSSQEYDVTWYVSSSPCVACAAKLTSILQQRKKLRLSVFCSRLFDWEEPEIVQGLKALVQAGCKLQMMKPADFQHVWETYVEKDQSFTLWEDCKENYEYYLEKLAD

SEQ ID NO: 580 - protein, 159 aa, Artificial Sequence
  Synthetic
FKFQFRNVEYSGRNKTLLCFRVDTAGGNAEPLKGYMEDETAHAEEAFFQQVLPNSSTEYDVTWYVSSSPCVACAAKLANILQQRKKLRLSIFCSRLFEWEEPEIVEGLKALARAGCKLRMMKPIDFQHVWEMYVEQGESFTPWEDCQENYEYYVERLTD

SEQ ID NO: 581 - protein, 159 aa, Artificial Sequence
  Synthetic
FKFQFRNVEYSGRNKTLLCFRVDTPGGSTEPLKGYMEDETAHAEEAFFQQVLPNTSQEYEVTWYLSSSPCVACAAKLAHILQQRKKVRLRMFCSRLFEWEEPEIVEGLRALVSAGCKLRMMKPSDFVHVWETYVEKDQNFEAWEDCQENYDYYVEKLTD

SEQ ID NO: 582 - protein, 159 aa, Artificial Sequence
  Synthetic
FKFQFRNVEYSGRNKTLLCFRVDSPGGSTEPLKGYMEDETAHAEEAFFQQVLPNPSLEYDITWYVSSSPCISCANTLAKMLQQRKKVRLCVFCSRLFEWDQPEVVEAIRTLVRAGCKLRMMKPSDFQHVWETYVEKGESFTPWEDCQDNYNYYKEILAD

SEQ ID NO: 583 - protein, 160 aa, Artificial Sequence
  Synthetic
FKFQFKNVEYSGRNKTLLCFLVDSQKGEDELQRGYLEDEGAHAEEAFFQQVLPEDPGRRYQVTWYVSSSPCAACAAKLAEILRARPTLRLTIFSARLFMWEEPEIQEGLKALAAAGCKLRVMKPVDFSYTWDTFVENDQTFSPWEDCQENYEYYQEKLAG

SEQ ID NO: 584 - protein, 160 aa, Artificial Sequence
  Synthetic
FRFQFKNVEYCGRNKTLLCYLVDQSSGADGLLRGFLEDEGLHAELAFFQLILPQDPSVNYTVTWYVSSSPCAHCCSKLLEILQERKTLRLNIFSARLLEAEEEEGQAGMKALAGAGCKLRVMKPLDFSYSWDTFVEHDERFTPWEDCQENYEYHHEKLAQ

SEQ ID NO: 585 - protein, 160 aa, Artificial Sequence
  Synthetic
FKFQFKNVEYSGRNKTLLCYLVDTGGAGDGLLRGYLEDEGIHAEEAFFTHCLPNDPNVQYTITWYVSSSPCHACSLKLAEVLKARKNVKLSIFSARLFEWEAEEVQAGLKALHSAGCKLRVMKPLDFSYTWDTFVETEQPLNLWEDCKDNYEYYHEKLDQ

SEQ ID NO: 586 - protein, 160 aa, Artificial Sequence
  Synthetic
FQFQFKNVEYSGRNKTFLCYLVDTGKADEGLQRGYLEDEGSHAEEAFFTQCLPHDPALKYSVTWYMSSSPCCACAAKMAEALKARRNIKLSIFAARLFEWEEAEIQAGLKALHIAGCKIRVMKPLDFSYTWDTFVENDQPLNLWADCKENYEYYHERLAD

SEQ ID NO: 587 - protein, 160 aa, Artificial Sequence
  Synthetic
FKFQFKNVEYSGRNKTLLCYLVDKGNTSDGLLRGYLEDEGTHAEEAFFTQCLPHNPALKYTVTWYVSSSPCSACAAKIAELLKDQKNLKLNIFAARLFEWEEGEIQAGLRTLHAAGCKLRVMKPLDFSYTWDTFVENDQSLNLWEDCKENYEYYHEKLSD

SEQ ID NO: 588 - protein, 160 aa, Artificial Sequence
  Synthetic
FKFQFKNVEYSGRNKTFLCYLVDKGNTADGLLRGYLEDEGSHAEEVFFIQCLPHDPTLKYTVTWYVSSSPCSACAAKIAEVLKARKNVKLSIFAARLFECEEVEIQAGLKALHAAGCKLRVMKPLDFSYTWDTFVENEQPLNLWEDCKENYEYYHEKLAD

SEQ ID NO: 589 - protein, 160 aa, Artificial Sequence
  Synthetic
FKFQFKNVEYSGRNKTFLCYLVDKGNTDDGLLRGYLEDEGSHAEEAFFIQCIPNDPSVRYTVTWYVSSSPCAACAAKIAEVLKARKNIKLSIFAARLFECEETDIQAGLKAMHTAGCKLRVMKPLDFSYTWDTFVENEEPLNLWEDCKENYEYYQEKLAD

SEQ ID NO: 590 - protein, 161 aa, Artificial Sequence
  Synthetic
FKFQFKNVEYSGRNKTFLCYIVETQGKESGTIRGYLEDEAAHAEDAFFNTILPEESSLRYNVTWYVSSSPCVACAERIAEILKKNKNLRLAILVSRLFMWEEPEMQAVLKKMKAAGCKLRIMKPQDFEYVWQNFVEQESKDFVPWEDIQENFLYYEEKLAE

SEQ ID NO: 591 - protein, 161 aa, Artificial Sequence
  Synthetic
FKFQFRNVEYSGRNKTFLCYIVETQGKESGSFRGYLEDEAAHAEGAFFNNILPTEPSLRYNVTWYVSSSPCVPCADQIAQILQKNKNLRLTILVSRLFMWEEPEMQAALKKLKTAGCKLKIMKPQDFEYIWQNFVEQEAKAFEPWEDIQENFLYYEEKLAE

SEQ ID NO: 592 - protein, 161 aa, Artificial Sequence
  Synthetic
FKFQFRNVEYSGRNKTFLCYVVEIQGKEPGSFQGYLEDEAAHAEDAFFNNILPTDPNLRYNVTWYVSSSPCVPCADRIAQVLQKNKNLRLSILVSRLFMWEEPEMQAALKKLKASGCKLKIMKPQDFEYIWQNFAEQEAKAFEPWEDIQENFLYYEEKLSE

SEQ ID NO: 593 - protein, 129 aa, Artificial Sequence
  Synthetic
FNFQFKNVEYSGRNKTFLCYIIEIQGKESKMLRGYLEDEAAHAEDAFFNTILPKESGMCYNVTWYSSCSPCIGCADRIAKALQKNKNLHLSIAVGRLFMWEEPDMQAALKKMKTAGCKLRIMKPQDFEY

SEQ ID NO: 594 - protein, 161 aa, Artificial Sequence
  Synthetic
FKFQFKNVEYSGRNKTFLCYIIEMQGKESKTLRGYLEDEAAHAEEAFFNTILPTEPGFRYEVTWYVSSSPCVSCAERIVKALKKNKNLRLSIAVGRLFMWEEPDIQAALKQMKAAGCKLRIMKPQDFEYVWKNFVEQEPKAFAPWDDIQENFQYYDEKLAE

SEQ ID NO: 595 - protein, 161 aa, Artificial Sequence
  Synthetic
FKFQFRNVEYSGRNKTFLCYVVETQGRESVTSRGYLEDEAAHAEMAFFNTILPKESSARYNVTWYVSSSPCVTCADRITETLKKNKNLRLTIMVGRLFMWEEPEMQAALKNMRAAGCKLRIMKPQDFEYVWQNFVEQEAKAFAPWEDIQENFQYYEEKLAE

SEQ ID NO: 596 - protein, 161 aa, Artificial Sequence
  Synthetic
FKFQFRNVEYSGRNKTFLCYVVETQGKEPVTSRGYLEDEAAHAEMAFFNTILPTQAGARHDVTWYVSSSPCVTCAQRICEALRKNKGLRLTIMVGRLFMWEEPEMQAALRSMKEAGCKLRIMKPQDFEYVWKNFVEQEAKSFVPWEDIQENFQYYEEKLAE

SEQ ID NO: 597 - protein, 161 aa, Artificial Sequence
  Synthetic
FKFQFRNVEYSGRNKTFLCYVIETQGKESVTSRGYLEDEAAHAEIAFFNTILPKESSLRYNVTWYVSSSPCVTCADRITETLKKNKNLRLTIMVGRLFMWEEPEMQAALKKMKSAGCKLRIMKPQDFEYVWQNFVEQEAKAFVPWEDIQENFQYYEEKLAE

SEQ ID NO: 598 - protein, 161 aa, Artificial Sequence
  Synthetic
FKFQFRNVEYSGRNKTFLCYVVETQGKESATSRGYLEDEAAHAEMAFFNTILPKDSSLRYNITWYVSSSPCVTCAERIIETLKKNKNLRLTIMVGRLFMWEEPEMQAALKNMKSAGCKLRIMKPQDFEYVWQNFVEQEAKDFVPWEDIQENFNYYEEKLAE

SEQ ID NO: 599 - protein, 161 aa, Artificial Sequence
  Synthetic
FKFQFRNVEYSGRNKTFLCYVVETQGKESKTSRGYLEDEASHAEIAFFNTILPKESSLRYNITWYVSSSPCVTCADRISETLRKNKNLRLTIMVGRLFMWEEPEMQAALKKMKSAGCKLRIMKPQDFEYVWQNFVEQEAKAFVPWEDIQENFQYYEEKLAE

SEQ ID NO: 600 - protein, 154 aa, Artificial Sequence
  Synthetic
FKFQFRNVEYSGRNKTFLCYVVETQGKENQTARGYLEDEAAHAEEAFFNSILPADQALKYNVTWYVSSSPCAACADRIADTLRRTPNLRLLLLVGRLFMWEEPEIQAALKKLKAAGCKLRIMKPQDFEYVWQNFVEQEAKAFVPWEDIQENFLY

SEQ ID NO: 601 - protein, 161 aa, Artificial Sequence
  Synthetic
FKFQFRNVEYSGRNKTFLCYVVEVQGKQGQISRGYLEDEAAHAEEAFFKTILPTDPALRYNVTWYVSSSPCAACADRISSTLSKTKNLKMLLLVGRLFMWEEPEIKTALKKLKESGCKLRIMKPQDFEYVWQNFVEQESKAFVPWEDIQENFLYYEEKLAE

SEQ ID NO: 602 - protein, 161 aa, Artificial Sequence
  Synthetic
FKFQFRNVEYSGRNKTFLCYVLEVQGKQGQMSRGYLEDETAHAEEAFFKTILPTDPALRYNVTWYVSSSPCAACADRISSTLSKNKNLRMLLLVGRLFMWEEPEIKAALKRLKEAGCKLRIMKPQDFEYVWQNFVEQESKAFVPWEDIQENFLYYEEKLAE

SEQ ID NO: 603 - protein, 161 aa, Artificial Sequence
  Synthetic
FKFQFRNVEYSGRNKTFLCYVVEAQGKQVQASRGYLEDEAAHAEEAFFNTILPTDPSLRYNVTWYVSSSPCAACADRIIKTLGKTKNLRLLILVGRLFMWEEPEIQTALKKLKEAGCKLRIMKPQDFEYIWQNFVEQESKAFEPWEDIQENFLYYEEKLAD

SEQ ID NO: 604 - protein, 161 aa, Artificial Sequence
  Synthetic
FKFQFRNVEYSGRNKTFLCYVVEAQGKQVQASRGYLEDEAAHAEEAFFNTILPADPALRYNVTWYVSSSPCAACADRIIKTLSKTKNLRLLILVGRLFMWEELEIQDALKKLKEAGCKLRIMKPQDFEYVWQNFVEQESKAFQPWEDIQENFLYYEEKLAD

SEQ ID NO: 605 - protein, 161 aa, Artificial Sequence
  Synthetic
FKFQFRNVEYSGRNKTFLCYVVEAQGKQVQATRGYLEDEAAHAEEAFFNTILPADPALRYNVTWYVSSSPCAACADRITKTLSKTKNLRLLILVGRLFMWEEPEIQAALKKLKEAGCKLRIMKPQDFEYIWQNFVEQESKAFQPWEDIQENFLYYEEKLAD

SEQ ID NO: 606 - protein, 161 aa, Artificial Sequence
  Synthetic
FKFQFRNVEYSGRNKTFLCYVVEAQGKQVQASRGYLEDEAAHAEEAFFNTILPADPALRYNVTWYVSSSPCAACADRIIKTLNKTKNLRLLILVGRLFMWEEPEIQAALKKLKEAGCKLRIMKPQDFDYVWQNFVEQESKAFEPWEDIQENFQYYEEKLAD

SEQ ID NO: 607 - protein, 161 aa, Artificial Sequence
  Synthetic
FKFQFRNVEYSGRNKTFLCYVVEVQAKQVQASRGYLEDEAAHAEEAFFNTILPADPALKYNVTWYVSSSPCAACADHIIKTLNKTKNLRLLILVGRLFMWEEPEIQAALKKLKEAGCKLRIMKPQDFEYIWQNFVEQESKAFEPWEDIQENFLYYEEKLAD

SEQ ID NO: 608 - protein, 161 aa, Artificial Sequence
  Synthetic
FKFQFRNVEYSGRNKTFLCYVVEAQAKQVQATRGYLEDEAAHAEEAFFNTILPADPALRYNVTWYVSSSPCAACADRIIKTLSKTKNLRLLILVGRLFMWEEPEIQAALRKMREAGCKLRIMKPQDFEYIWQNFVEQESKAFEPWEDIQENFLYYEEKLAD

SEQ ID NO: 609 - protein, 161 aa, Artificial Sequence
  Synthetic
FKFQFRNVEYSGRNKTFLCYVVEAQSKQVQATRGYLEDEGAHAEEAFFNTILPADPALKYNVTWYVSSSPCAACADRILKTLSKAKNLRLLILVGRLFMWEEPEVQAALKKLKEAGCKLRIMKPQDFEYIWQNFVEQESKAFEPWEDIQENFLYYEEKLAD

SEQ ID NO: 610 - protein, 161 aa, Artificial Sequence
  Synthetic
FKFQFRNVEYSGRNKTFLCYVVEVQSKQAQATQGYLEDEGAHAEEAFFNTILPADPALKYNVTWYVSSSPCAACADRILKTLSKTKNLRLLILVSRLFMWEEPEVQAALKKLKEAGCKLRIMKPQDFEYIWQNFVEQESKAFEPWEDIQENFLYYEEKLAD

SEQ ID NO: 611 - protein, 161 aa, Artificial Sequence
  Synthetic
FKFQFRNVEYSGRNKTFLCYVVEAQSKQVQASRGYLEDEAAHAEEAFFNTIMPADPALRYNVTWYVSSSPCAACADRIIKTLSKTKNLRLLILVGRLFMWEEPEIQAALKKLKEAGCRLRIMKPQDFEYVWQNFVEQESKTFEPWEDIQENFLYYEEKLAD

SEQ ID NO: 612 - protein, 161 aa, Artificial Sequence
  Synthetic
FKFQFRNVEYSGRNKTFLCYVVEAQSKQVQASRGYLEDETNHAEEAFFNSIMPTDPALRYMVTWYVSSSPCAACADRIVKTLNKTKNLRLLILVGRLFMWEEPEIQAALRKLKEAGCRLRIMKPQDFEYIWQNFVEQESKAFEPWEDIQENFLYYEEKLAD

SEQ ID NO: 613 - protein, 161 aa, Artificial Sequence
  Synthetic
FKFQFRNVEYSGRNKTFLCYVVEAQSKQVQATRGYLEDEAAHAEEAFFNTIMPTDPALRYIVTWYVSSSPCAACADRIIKTLNKTKNLRLLILVGRLFMWEEPEIQAALRKLKEAGCKLRIMKPQDFEYVWQNFVEQESKAFEPWEDIQENFLYYEEKLAD

SEQ ID NO: 614 - protein, 161 aa, Artificial Sequence
  Synthetic
FKFQFRNVEYSGRNKTFLCYVIEAQSKQVQATRGYLEDEAAHAEEAFFNTILPADPAVRYVVTWYVSSSPCAACADRIIKTLNKAKNLRLLILVGRLFMWEEPEIQAALRRLKEAGCRLRIMKPQDFEYVWQNFVEQESKAFEPWEDIQENFLYYEEKLAD

SEQ ID NO: 615 - protein, 161 aa, Artificial Sequence
  Synthetic
FKFQFRNVEYSGRNKTFLCYVVEVQSKQVQASRGYLEDEAAHAEEAFFNSVLPADPALRYNVTWYVSSSPCAACADRIIKTLGKTKNLRLLILVGRLFMWEEPEIQAALRKLKEAGCRLRIMKPQDFEYVWQNFVEQESKAFEPWEDIQENFLYYEDKLAD

SEQ ID NO: 616 - protein, 161 aa, Artificial Sequence
  Synthetic
FKFQFRNVEYSGRNKTFLCYVVEVQSKQVQASRGYLEDEAAHAEEAFFNTILPADPALRYSVTWYVSSSPCVACADRIVKTLGKTKNLRLLILVGRLFMWEEPEIQAALRKLKEAGCRLRIMKPQDFEYVWQNFVEQESKAFEPWEDIQENFLYYEEKLAD

SEQ ID NO: 617 - protein, 161 aa, Artificial Sequence
  Synthetic
FKFQFRNVEYSGRNKTFLCYVVEVQCKQVQASRGYLEDEAAHAEEAFFNTILPADPALRYNVTWYVSSSPCVACADRIIKTLAKTKNLRLLILVGRLFMWEEPEMQAALRKLKEAGCRLRIMKPQDFEYVWQNFVEHESKAFEPWEDIKENFLYYEEKLAD

SEQ ID NO: 618 - protein, 161 aa, Artificial Sequence
  Synthetic
FKFQFRNVEYSGRNKTFLCYVIEVQDKQVQASRGYLEDETAHAEEAFFNTVVPTDPALRYNVTWYVSSSPCVACADRIIKMLSKTKNLRLLILVGRLFMWEEPAMQAALKKLKEAGCRLRIMKPQDFEYIWQNFVEQESKAFEPWEDIQENFLYYEEKLAD

SEQ ID NO: 619 - protein, 161 aa, Artificial Sequence
  Synthetic
FKFQFRNVEYSGRNKTFLCYVVEVQGKQVQATRGYLEDEAAHAEEAFFNTILPADPALRYNVTWYVSSSPCAACADRIIRTLGKTKNLRLLILVGRLFMWEEPEIQAALKKLREAGCRLRIMKPQDFEYVWQNFVEQEAKAFEPWEDIQENFLYYEEKLAD

SEQ ID NO: 620 - protein, 161 aa, Artificial Sequence
  Synthetic
FKFQFRNVEYSGRNKTFLCYVVEAQGKQVQASRGYLEDEAAHAEEAFFNTILPADPAVRYNVTWYVSSSPCAACADRIVRTLGKTKNLRLLILVGRLFMWEEPDVQAALRRLKEAGCRLRIMKPQDFEYVWQNFVEQESKAFEPWEDIQENFLYYEEKLAD

SEQ ID NO: 621 - protein, 161 aa, Artificial Sequence
  Synthetic
FKFQFRNVEYSGRNKTFLCYVVEAQGKQVQATRGYLEDEAAHAEEAFFNTILPADPALRYTVTWYVSSSPCAACADRIARTLGQTKNLRLLILAGRLLLWEEPDVRAALRRLAEAGCRLRVMKPQDFEYVWQQFVEQEPKAFEPWEDIQENFLYYEEKLAD

SEQ ID NO: 622 - protein, 161 aa, Artificial Sequence
  Synthetic
FKFQFRNVEYSGRNKTFLCYVVETQAKQVQATRGYLEDETNHAEEAFFNTILPSDPALRYNVTWYVSSSPCAACADRILRTLGKTKNLRLLILVGRLFMWEEPEVQAALRKLKEAGCRLRIMKPQDFEYVWQNFVEQESKAFEPWGDIQENFLYYEEKLAD

SEQ ID NO: 623 - protein, 161 aa, Artificial Sequence
  Synthetic
FKFQFRNVEYSGRNKTFLCYVVEAQGKQVQASRGYLEDEAAHAEEAFFNTILPTDPALRYNVTWYVSSSPCAACADRIIRTLGKTKNLRLLILVGRLFMWEEPEVQAALRKLKEAGCRLRIMKPQDFEYVWQNFVEQESKAFQPWEDIQENFLYYEEKLAD

SEQ ID NO: 624 - protein, 163 aa, Artificial Sequence
  Synthetic
FYFHFKNCPDHGRNGCYLCYEVKRQRGLPLVGTGVFENEPKHTEICFLNWFKTQQNLSREEKYHVTWFMSWSPCFQCARQVVEFLKDHEYVQLSIFVARLYYSSRPEYQQGLRSLQGAGAQVAIMTPDDFAYCRKVFVHDHKPFRYWKGIYINSCSLSKTLED

SEQ ID NO: 625 - protein, 158 aa, Artificial Sequence
  Synthetic
FNSNFKNLDGGCKSTFLCFEVEREDGSVLYQNGVFRNQHAELCFIEWFHEKVLCPDAQYHVTWYISWSPCFECAEQVADFLNENENVDLSISAARLYLCEDEDEQGLQDLVATGAKVAMMAPEDFKYCWDNFVYNGWQFTYWKNVRRNYGRLQEKLDE

SEQ ID NO: 626 - protein, 115 aa, Artificial Sequence
  Synthetic
NSCSLSKTEDILRHAELCFLDWFREKVLCPDAQYHVTWYISWSPCFECAEQVADFLNENENVDLSISAARLYLCEDEDEQGLQDLVATGAKVAMMAPEDLTAKMVPDETPMFDPS

SEQ ID NO: 627 - protein, 161 aa, Artificial Sequence
  Synthetic
FSFHFKNLMFAGRNCTYLCYQVKREHCSPVPDKGVFQNEPCHAELCFLSWFNKRLSPDECYHITWFMSWSPCFACTEQVAKFLEKNRNVRLSIFAARLYYFWQPAVQQGLRRLHGVGACVGIMSYQDFKYCWENFVYNRMPFKPWEKQCENSKILVTKLEE

SEQ ID NO: 628 - protein, 159 aa, Artificial Sequence
  Synthetic
FSFHFRNLEFAGRNCSYICYRVEGLSGSPGSEQGVFLNECRHAELCFLHWFRGRLSPDEYYHVTWFISWSPCSNCAREVAEFLKRHRNVELSIFAARLYYWQRNKPDLRNLCSSGAQLAIMFYQDFRYCWDNFVHNGREFIPWEKINVNSRLLATNLEE

SEQ ID NO: 629 - protein, 143 aa, Artificial Sequence
  Synthetic
FSFHFRNLKFAGRKCSYLCYRVEGLSGSPGSEQGVFLNERRHAELCFLDWFRVRLSPDEYYRVTWFISWSPCSYCAREVADFLKQYRNVKLSIFAARLYYCRDHAQGLRSLCSSGAQLAIMFFWDFRYCWDNFVHNGRDFIPW

SEQ ID NO: 630 - protein, 162 aa, Artificial Sequence
  Synthetic
FYFQFCNLLYARRNCSYICYKVERKYHSRAFDWGVFHNQRCHTELRFLSWFHAEKLRPNERYHITWFMSWSPCMKCAKEVADFLGRHQNVTLSIFTARLYNFQEEGSRQGLLRLSDQGAHVDIMSYQEFKYCWKKFVNSRRPFRPWKKLYRNYQRLVEELED

SEQ ID NO: 631 - protein, 162 aa, Artificial Sequence
  Synthetic
FFFEFQNLLYAGRKSSYLCFQVERQHSSPVSDWGVFENQPYHAELCFLNWFRAEKLSPYEHYDVTWFLSWSPCSTCAEEIAIFLSNHKNVRLSIFVSRIYYFWKPAFRQGLQELDHLGVQLDAMSFDDFKYCWENFVDNGMPFRCWKKVHRNYKFVLRKLNE

SEQ ID NO: 632 - protein, 161 aa, Artificial Sequence
  Synthetic
FRFHFPNLLYAGRKLCYLCFQVETDYFSCDSDRGVFRNKRCHAEQCFLSWFRDQYPCRDEYYNVTWFLSWSPCPTCAEEVVEFLEEYRNLTLSIFTSRLYYFYHPNYQQGLRKLWDAGVQLDIMSCDDFEHCWDNFVDHGMRFQRRNLLKDYDFLAAELQE

SEQ ID NO: 633 - protein, 158 aa, Artificial Sequence
  Synthetic
FFFQFPSLCYAGRKFCYLCFQVGRGHPSDWGVFRNKPYHAESCFLSWFRAQNLSPDEDYHVTWFSSWSPCHTCADEVVEFLGQYRHVTLSIFAARLYYFWDPPFQNGLRRLQSAGVRLDIMSFADYKRCWENFVDHGMRFQSRNLLRHRDLLASRLEN

SEQ ID NO: 634 - protein, 161 aa, Artificial Sequence
  Synthetic
FYFHFQNLLFAGRNTTFLCCRVDKERHGTVLVSGVFTHQYHAESHFLLWFQKNFLSLDKDFQVTWYLSWSPCPACAKQVADFLAVHRNVSLTIFSARLYYFWDPEFRDGLHRLFEKGARVAIMSPKDFENCWEGFVFNGRDFRPWDNMVENYQSLRITLQE

SEQ ID NO: 635 - protein, 162 aa, Artificial Sequence
  Synthetic
FLFHFRNLRWAGRNNTFLCYQVDRERDSTVIHRGVFKTQRLHAELCFLYWLHDYPLFPDQHFHITWFISWSPCSDCAQQVAAFLASHSNLSLTVYTARLYYFWKHSYQEGLRALQREGARVEIMSIREFEHCWENFVYPGRPFRPWKNLFRNYYFQVKKLQK

SEQ ID NO: 636 - protein, 162 aa, Artificial Sequence
  Synthetic
FYFHFKNLRYALRKNTFLCYEVNRECNELVLCQGVFRKENLHAEVCFLYWFHTQVLPPDEKYKITWYVSWSPCNECAEKVASFLDTHRNLSLAIFSSRLYYFWDPDYQDKLRRLNQAGAQIAAMDFPEFEKCWNKFVDNGKSFRPWKRLKINFRFQDNKLRD

SEQ ID NO: 637 - protein, 162 aa, Artificial Sequence
  Synthetic
FYFHFKNVRYAGRKNNFLCYEVNGDCALPVLRQGVFRKQHIHAELCFIYWFHDKVLSPMEEFKVTWYMSWSPCSKCAEQVARFLAAHRNLSLAIFSSRLYYYLNPNYQQKLCRLIQEGVHVAAMDLPEFKKCWNKFVDNGQPFRPWMRLRINFSFYDCKLQE

SEQ ID NO: 638 - protein, 162 aa, Artificial Sequence
  Synthetic
FKFHFKNLRYADRKDTFLCYEVTRDCDSPVLHHGVFKNKNIHAEICFLYWFHDKVLSPREEFKITWYMSWSPCFECAEQVLRFLATHHNLSLDIFSSRLYNIRDPENQQNLCRLVQEGAQVAAMDLYEFKKCWKKFVDNGRRFRPWKKLLTNFRYQDSKLQE

SEQ ID NO: 639 - protein, 162 aa, Artificial Sequence
  Synthetic
FKFHFKNLGYAGRKDTFLCYEVTRDCDSPVLHHGVFKNKNIHAEICFLYWFHDKVLSPREEFKITWYMSWSPCFECAEQIVRFLATHHNLSLDIFSSRLYNVQDPETQQNLCRLVQEGAQVAAMDLYEFKKCWKKFVDNGRRFRPWKRLLTNFRYQDSKLQE

SEQ ID NO: 640 - protein, 162 aa, Artificial Sequence
  Synthetic
FYFHFENLQKAGRNETWLCFAVEIKQHSTVWKTGVFRNQHCHAERCFLSWFCDNTLSPKKNYQVTWYISWSPCPECAGEVAEFLATHSNVKLTIYTARLYYFWDTDYQEGLRSLSEEGASMEIMGYEDFKYCWENFVYNGEPFKPWKGINTNFRFLERRLWK

SEQ ID NO: 641 - protein, 162 aa, Artificial Sequence
  Synthetic
FYFHFKNLRTADRNETWLCFAVEIKQRSTVWRTGVFRNQHCHAERCFLSWFRDNPLSPKKNYQVTWYTSWSPCPECAGEVAEFLARYSNVQLTIYTARLYYFWDTDYQEGLRSLSEEGASVEIMGYEDFKYCWENFVCDGEPFKPWKGINTNFRFLERHLRK

SEQ ID NO: 642 - protein, 162 aa, Artificial Sequence
  Synthetic
FYFHFKNLRKAGRNESWLCFTMEVKHHSPVWKRGVFRNQHCHAERCFLSWFCDDILSPNTNYQVTWYTSWSPCPECAGEVAEFLARHSNVNLTIFTARLYYFWDTDYQEGLRSLNQEGASVKIMGYKDFKYCWENFVYNDEPFKPWKGLKYNFLFLDSKLQE

SEQ ID NO: 643 - protein, 162 aa, Artificial Sequence
  Synthetic
FYFHFKNLRKAGRNESLLCFTMEIKQCSTVWKRGVFRNQHCHAERCFLSWFCEDILSPNTDYQVTWYTSWSPCLDCAGEVAEFLARHSNVKLAIFAARLYYFWDTDYQQGLRSLSEEGASVQIMGYEDFKYCWENFVYNDEPFKPWKGLKYNFLFLDSKLQE

SEQ ID NO: 644 - protein, 162 aa, Artificial Sequence
  Synthetic
FYFHFKNLRKAGRNESWLCFTMEIKQCSTVWKRGVFRNQRCHAERCFLSWFCEDILSPNTDYQVTWYTSWSPCLDCAGEVAEFLARHSNVKLTIYTARLYYFWHTDYQQGLRSLSEEGASVEIMGYEDFKCCWENFVYNDEPFKPWKGLKYNFLFLDSKLQE

SEQ ID NO: 645 - protein, 162 aa, Artificial Sequence
  Synthetic
FYFQFKNLWEADRNETWLCFTVEGKRRSVVWKTGVFRNQHCHAERCFLSWFCDDILSPNTNYQVTWYTSWSPCPECAGEVAEFLARHSNVNLTIFTARLYYFWDTDYQEGLRSLNQEGASVKIMGYKDFKYCWENFVYNDEPFKPWKGLKYNFLFLDSKLQE

SEQ ID NO: 646 - protein, 162 aa, Artificial Sequence
  Synthetic
FYFQFKNLWEADRNETWLCFTVEGKRRSVVWKTGVFRNQHCHAERCFLSWFCDDILSPNTNYEVTWYTSWSPCPECAGKVAEFLARHSNVNLTIFTARLCYFWDTDYQEGLRSLNQEGASVKIMGYKDFVSCWKNFVYSDEPFKPWKGLQTNFRLLKRRLRE

SEQ ID NO: 647 - protein, 162 aa, Artificial Sequence
  Synthetic
FYDNFENEPILGRSYTWLCYEVKIRGRSNLWDTGVFRGEHCHAERCFLSWFCDDILSPNTNYEVTWYTSWSPCPECAGEVAEFLARHSNVNLTIFTARLCYFWDTDYQEGLCSLSQEGASVKIMGYKDFVSCWKNFVYSDEPFKPWKGLQTNFRLLKRRLRE

SEQ ID NO: 648 - protein, 162 aa, Artificial Sequence
  Synthetic
FYFHFKNLLKAGRNESWLCFTMEVKHHSAVRKRGVFRNQHCHAERCFLSWFCDDILSPNTNYEVTWYTSWSPCPECAGEVAEFLARHSNVNLTIFTARLCYFWDTDYQEGLCSLSQEGASVKIMGYKDFVSCWKNFVYSDEPFKPWKGLQTNFRLLKRRLRE

SEQ ID NO: 649 - protein, 162 aa, Artificial Sequence
  Synthetic
FYFQFKNLWEADRNETWLCFTVEGKRRSVVWKTGVFRNQHCHAERCFLSWFCDDILSPNTNYQVTWYTSWSPCPECAGEVAEFLARHSNVNLTIFTARLYYFQDTDYQEGLRSLSQEGVAVKIMDYKDFKYCWENFVYNDEPFKPWKGLKYNFRFLKRRLQE

SEQ ID NO: 650 - protein, 162 aa, Artificial Sequence
  Synthetic
FYFQFKNLWEADRNETWLCFTVEGKRRSVVWKTGVFRNQHCHAERCFLSWFCDDILSPNTKYQVTWYTSWSPCPDCAGEVAEFLARHSNVNLTIFTARLYYFQYPCYQEGLRSLSQEGVAVEIMDYEDFKYCWENFVYNNEPFKPWKGLKTNFRLLKRRLRE

SEQ ID NO: 651 - protein, 162 aa, Artificial Sequence
  Synthetic
FYFQFKNLWEADRNETWLCFTVEVKHHTVVWKRGVFRNQHCHAESCFLSWFCNNILSPNTNYRVTWYASWSPCPECAGEVAKFLARHSNVKLTIFTARLYYFQNPYYQQGLRRLSQEGVAVGIMDYEDFKDCWENFVYSDEPFKPWKGINTNFRLLKKRLRE

SEQ ID NO: 652 - protein, 162 aa, Artificial Sequence
  Synthetic
FYFQFKNLWEANRNETWLCFTVEVKQRSTVWERGVFQNQHCHAERCFLSWFCEDILSPNTDYQVTWYTSWSPCPECAGEVAEFLARHNNVMLTIYTARLYYSQDPNYQQGLRSLSEKGVSVKIMDYEDFKYCWENFVYNDEPFKPWKGLKYNFLFLDSKLQE

SEQ ID NO: 653 - protein, 162 aa, Artificial Sequence
  Synthetic
FYFQFKNLREANRNETWLCFTVEGRHHLTVWKTGVFRNQHCHAEKCFLSWFCKNILSPNTDYQVTWYTSWSPCPECAREVAKFLARHNNVMLTIYTARLYYSQCPNYQQGLRSLSEKGVSVEIMDYEDFKYCWQNFVYDGEPFKPWKGLKTSFRFLKRCLRE

SEQ ID NO: 654 - protein, 162 aa, Artificial Sequence
  Synthetic
FYFQFKNLREANRNETWLCFAVEIKQRSTVLKTGVFRNQHCHAERCFLSWFCEDILSPNTDYQVTWYTSWSPCLDCAGEVAKFLARHNNVMLTIYTARLYYSQYPNYQQGLRSLSEKGVSVKIMDYEDFKYCWEKFVYDGEPFKPWKGLKTSFRFLKRRLRE

SEQ ID NO: 655 - protein, 120 aa, Artificial Sequence
  Synthetic
LHAELSFLSWFHDTELSFDENYKVTWYMSWSPCPECAKEIVTFLDNHHNVTLTIYVARLYYHWNPTYKEGLRALVQGGTRLYTMAFPEFEDCWSLFVNETFRPWENFHKCCSLQDKTLQK

SEQ ID NO: 656 - protein, 158 aa, Artificial Sequence
  Synthetic
FYFHFENLPYAGRNKTFLCYEVKRRDNKLHKGVVQNQLSRTELSFISCFHATELCLDETYKVTWYISWSPCVECAEEIVKFLANHRNVFLTVFIARLYYYREHTFKEGLQALDNGGVQMHMMCLQDFKDCWSLFVSETFRPWKGLRKYYLFQNKTLKQ

SEQ ID NO: 657 - protein, 157 aa, Artificial Sequence
  Synthetic
FYFHFENLPNAGRHKTFLCFEVKNNELHKGFFLNQLHAELRFLSWLHDTCLCPYEYYQVTWYMSWSPCVECAEELTTFLAGHRNVTLTIYVARLYYHQFPVYKNRLQALIKKGATVKVMFFRDFLYCWRRFVYNFKRFYDWPNLHKNSLHYYKTLQH

SEQ ID NO: 658 - protein, 160 aa, Artificial Sequence
  Synthetic
FYFHFENLPDPGWNKTFLCYEVKRQDQKLRKGVFQNQPLHAELRFLSWFHDTLLCPLGSYQVTLYVSWSPCSECAEELTTFLAGHRNVTMTIYVAQLYYCNKSPNREGLKILIAEDARLRVMFYDEFLYCWRNFVKNYNNFDPWSLLDENSRYHNRILQN

SEQ ID NO: 659 - protein, 160 aa, Artificial Sequence
  Synthetic
FRFYFRNLRCAGRNKTFLCYEVKRRDNKLHKGVVLNQPLHAELRFLSWFHDTLLCPLGSYQVTLYVSWSPCSECAEELTTFLAGHRNVTMTIYVAQLYYCNKSPNREGLKILIAEDARLRVMFYDEFLYCWRNFVKNYNNFDPWSLLDENSRYHNRILQN

SEQ ID NO: 660 - protein, 160 aa, Artificial Sequence
  Synthetic
FKFHFENLPNPGWHKTFLCYTIESQKNRLRNGVFQNQRLHAELRFLSWFHDNWLCPGNSYRVTFYMSWSPCSECAEELTTFLAGHRNVTLTIFFSKLYYCDDSSNREGLKTLAAGGARLFVMFDTDFSYCWTNFVNCYNYFEPWPLLDDNSKYCNRILQK

SEQ ID NO: 661 - protein, 160 aa, Artificial Sequence
  Synthetic
FYFHFNNLCFAGRNKTFLCYTIESKKNRLRNGVFQNQRLHAELRFLSWFHDNWLCPGNSYQVTLYMSWSPCSECAEELTTFLAGHRNVTLTIFFSKLYCCDDSPHREGLKTLAAGGARLFVMFDTDFSYCWTNFVNCYNYFEPWPLLDDNSKYYKSILQK

SEQ ID NO: 662 - protein, 158 aa, Artificial Sequence
  Synthetic
FNCHFNNRPYLRRNDTWLCFEVKTSSNSPGFYSGVFQNQPWHTELCILTWARPMLSHHHFYQITWYMSWSPCANCAWQVAAFLATHENVSLTIYTAHIYYMWRQDYRQGMLRMIEEGTRVYIMFSKEFQHCWENFVDHGMCWNRVKKNYEFLVTQLNE

SEQ ID NO: 663 - protein, 149 aa, Artificial Sequence
  Synthetic
FYNQFNNTPVPGRTDTWLCFEVKNNSNSPGFHRGSSENRHAEVGFLTWFQKEMPPNHHYEVTWYISWSPCVHCAWHVVNFLTSNPNMTLTIFAARLYYIYHPEEGTKVHIVSLKEFKYCWAKLVYNGMRFMPWYQFNENYQLLVTQLKK

SEQ ID NO: 664 - protein, 144 aa, Artificial Sequence
  Synthetic
FYYNFENRSVLGWNTTWLCHKVKTKDPSKLLDTRIFGGQHHPEMRFLDWFCKYISRSPCPEYAEKVAEFLVKNGKVTLTIFVAHLYYFWEPDYQNGVRPHASMTIMNYDEFQHCWDKFVYNRMLFDPWKQLNTNYALLHSMLGE

SEQ ID NO: 665 - protein, 122 aa, Artificial Sequence
  Synthetic
QHHPEMRFLHWFRKWKLHSDQEYEVTWFVSWSPCPVCARNVAEFLTEDGKVTLTIFVARLYYFWIPHYREELRRLCQPRATMKIMSYGEFQHCWDKFVDNRLYKPWNKLPKHYTLLHITLGE

SEQ ID NO: 666 - protein, 163 aa, Artificial Sequence
  Synthetic
FFYNFNNRPILRRNTVWLCYEVKTRGPSMPWDAKIFRGQKYHPEMRFLHWFRKWRQLHRDQEYEVTWYVSWSPCTGCANSVATFLAEDPKVTLTIFVARLYYFWKPDYQEALRVLCQPHATMKIMNYNEFQHCWNKFVRGREPFEPWENLPKHYTLLHATLGE

SEQ ID NO: 667 - protein, 163 aa, Artificial Sequence
  Synthetic
FFYNFNNRPILRRNTVWLCYEVKTRGPSVPWGTKIFRGQKYHPEMRFLRWFHKWRQLHHDQEYKVTWYVSWSPCTRCANSVATFLAKDPKVTLTIFVARLYYFWKPDYQQALRILCQPHATMKIMNYNEFQDCWNKFVDGGKPFKPRNNLPKHYTLLQATLGE

SEQ ID NO: 668 - protein, 163 aa, Artificial Sequence
  Synthetic
FVYYFNNRPILGRNIVWLCCEVKTKDPSGPLDANIFQGEKDHPEMKFLHWFRKWRQLHRDQEYEVTWYVSWSPCTRCANSVATFLAEDPKVTLTIFVARLYYFWKPHYQEALRILCQPHATMKIMNYNEFQHCWNEFVDGGKPFKPRKNLPKHYTLLHATLGE

SEQ ID NO: 669 - protein, 163 aa, Artificial Sequence
  Synthetic
FVSNFNNRPILGLNTVWLCCEVKTKDPSGPLDAKIFQGKKYHPEMRFLRWFHKWRQLHHDQEYKVTWYVSWSPCTRCANSVATFLAKDPKVTLTIFVARLYYFWKPDYQQALRILCQPHATMKIMNYNEFQDCWNKFVDGGKPFKPRNNLPKHYTLLQATLGE

SEQ ID NO: 670 - protein, 160 aa, Artificial Sequence
  Synthetic
FSYNFKNRPILRRNTVWLCYEVKTKGPSRPLDAKIFRGQKNHPEMRFFHWFSKWRTLHRDQECEVTWYMSWSPCTKCTRNVATFLAEDPKVTLTIFVARLYYFWDPDYQEALRSLCRPRANMKIMNYDEFQHCWNKFVYSRELFEPWNNLPKYYIPLHKV

SEQ ID NO: 671 - protein, 162 aa, Artificial Sequence
  Synthetic
FSYNFYNRPILRRNTVWLCYEVKTKGPSRPLDAKIFRGQKYHPEMRFFHWFSKWRKLHRDQEYEVTWYISWSPCTKCTRDMATFLAEDPKVTLTIFVARLYYFWDPDYQEALRSLCQPRATMKIMNYDEFQHCWSKFVYSRELFEPWNNLPKYYILLHIMLG

SEQ ID NO: 672 - protein, 162 aa, Artificial Sequence
  Synthetic
FSYNFNNRPILRRNTVWLCYEVKTKDPSRPLDAKIFRGQKYHPEMRFFHWFSKWRKLHRDQEYEVTWYISWSPCTKCTRNVATFLAEDPKVTLTIFVARLYYFWDQDYQEALRSLCQPRATMKIMNYDEFQHCWSKFVYSRELFEPWNNLPKYYMLLHIMLG

SEQ ID NO: 673 - protein, 162 aa, Artificial Sequence
  Synthetic
FSYNFNNRPILRRNTVWLCYEVKTKGPSRPLDAKIFRGQQYHAEMCFLSWFCGNQLPAYKCFQITCFVSWTPCPDCVAKLAEFLAEHPNVTLTISAARLYYYWERDYRRALRRLRQAGARVKIMDDEEFAYCWENFVYSGQPFMPWHKFDDNYAFLHRTLKE

SEQ ID NO: 674 - protein, 162 aa, Artificial Sequence
  Synthetic
FSYNFYNRPILRRNTVWLCYEVKTKGPSRPLDAKIFRGQEHHAEMCFLSWFCGNQLPAYKCFQITWFVSWTPCPDCVAKLAEFLAEHPNVTLTISAARLYYYWERDYRRALCRLSQAGARVKIMDDEEFAYCWENFVYSGQPFMPWYKFDDNYAFLHRTLKE

SEQ ID NO: 675 - protein, 146 aa, Artificial Sequence
  Synthetic
WFCFEVKTRGPSMPWDAKIFRGQQYHAEMCFLSRFCGNQLPAYKRFQITWFVSWTPCPDCVVKVAEFLAEHPNVTLTISAARLYYYWETDYRRALCRLRQAGAHVKIMDNEEFAYCWENFVYNGQSFMPWDKFDDNYAFLHCKLKE

SEQ ID NO: 676 - protein, 162 aa, Artificial Sequence
  Synthetic
FYYHFENKPILGRSYTWLCYEVKIKDPSKLWYTGVFRGQEHHAEMCFLSRFCGNQLPAYKRFQITWFVSWNPCPDCVAKVIEFLAEHPNVTLTISTARLYYYWGRDWQRALCRLRQAGARVKIMDYEEFAYCWENFVYNGQSFMPWDKFDDNYAFLHCKLKE

SEQ ID NO: 677 - protein, 123 aa, Artificial Sequence
  Synthetic
EHHAEMCFLSRFCGNQLPAYKRFQITWFVSWNPCPDCVAKVIEFLAEHPNVTLTISTARLYYYWGRDWQRALCRLRQAGARVKIMDYEEFAYCWENFVYNDQSFMPWYKFNDNYAFLHRMLKE

SEQ ID NO: 678 - protein, 162 aa, Artificial Sequence
  Synthetic
FYYNFENEPILGRRYTWLCYEVKIKDPSKLWDTGVFPGQQYHAEMYFLSWFCGNQLPAYKHFQITWFVSWNPCPDCVAKVTEFLAEHRNVTLTISAARLYYYWGKDWRRALCRLHQAGARVKIMDDEEFAYCWENCVYNGQPFMPWDKFDDNYAFLHLKLKE

SEQ ID NO: 679 - protein, 162 aa, Artificial Sequence
  Synthetic
FDYNFENEPILGRSYTWLCYEVKIEDPSKLWDTGVFQGQQYHAEMCFLSRFCGNQLPAYKRFQITWFVSWNPCPDCVAKVTEFLAEHPNVTLTISAARLYYYWGRDWRRALRRLHQAGARVKIMDYEEFAYCWENFVYNGQSFMPWDKFDDNYAFLHCKLKD

SEQ ID NO: 680 - protein, 162 aa, Artificial Sequence
  Synthetic
FNYNFENEPILGRSYTWLCYEVKIKDPSKLWDTGVFRGQQYHAEMCFLSWFCGNQLPAYKRFQITWFVSWNPCPDCVAKVTEFLAEHPNVTLTISAARLYYYWGKDWRRALRRLHQAGALVKIMDYEEFAYCWENFVYNGQSFMPWDKFDDNYASLHCKLKE

SEQ ID NO: 681 - protein, 162 aa, Artificial Sequence
  Synthetic
FYYHFENEPILGRSYTWLCYEVKIKDPSKLWDTGVFRGQEHHAEMCFLSWFCGNQLPAHKRFQITWFVSWTPCPDCVAKVAEFLAEYPNVTLTISAARLYYYWETDYRRALCRLRQAGARVKIMDYEEFAYCWENCVYNGQPFMPWYKFDDNYAFLHHKLKE

SEQ ID NO: 682 - protein, 162 aa, Artificial Sequence
  Synthetic
FYYNFENEPILRRSYTWLCYEVKIKDPSKLWDTGVFRGQEYHAEMCFLSWFCGNQLPAYKRFQITWFVSWTPCPDCVAKVAVFLAEHPNVTLTISAARLYYYWEKDWQRALCRLSQAGARVKIMDYEEFEYCWENFVYNGEPFMPWYKFDDNYAFLHHTLKE

SEQ ID NO: 683 - protein, 162 aa, Artificial Sequence
  Synthetic
FYYDFENEPILRRNYTWLCYEVKIKDPSKLWDTGVFRGQEHHAEMCFLSWFCGNQLSAYERFQITWFVSWTPCPDCVAKLAEFLAEHPNVTLTVSAARLYYYWERGYRRALRRLRQAGAHVKIMDYEEFAYCWENFVYNGQPFMPWYKFDDNYAFLHHTLKE

SEQ ID NO: 684 - protein, 162 aa, Artificial Sequence
  Synthetic
FYYNFENEPILGRSYTWLCYEVKIRGHSNLWDTGVFRGQEHHAEMCFLSWFCGNQLSAYKCFQITWFVSWTPCPDCVAKLAKFLAEHPNVTLTISAARLYYYWERDYRRALCRLSQAGARVKIMDDEEFAYCWENFVYNGQPFMPWYKFDDNYAFLHRTLKE

SEQ ID NO: 685 - protein, 162 aa, Artificial Sequence
  Synthetic
FYDNFENEPILGRSYTWLCYEVKIRGRSNLWDTGVFRGPENHAEMCFLSWFCGNRLPANRRFQITWFVSWNPCLPCVVKVTKFLAEHPNVTLTISAARLYYYRDRDWRWVLLRLHKAGARVKIMDYEDFAYCWENFVCNGQPFMPWYKFDDNYASLHRTLKE

SEQ ID NO: 686 - protein, 162 aa, Artificial Sequence
  Synthetic
FYDNFENEPILGRSYTWLCYEVKIRGRSNLWDTGVFRGQQYHAEMCFLSWFCGNQLPAYKCFQITWFVSWTPCPDCVAKLAEFLSEHPNVTLTISAARLYYYWERDYRRALCRLSQAGARVTIMDYEEFAYCWENFVYNGQQFMPWYKFDENYAFLHRTLKE

SEQ ID NO: 687 - protein, 162 aa, Artificial Sequence
  Synthetic
FYDNFENEPILGRSYNWLCYEVKIRGRSNLWNTGVFRGQEHHAEMCFLSWFCGNQLPAYKCFQITWFVSWTPCPDCVAKLAEFLAEYPNVTLTISTARLYYYWERDYRRALCRLSQAGARMKIMDYEECAYCWENFVYKGQQFMPWYKFDENYAFLHHTLKE

SEQ ID NO: 688 - protein, 1824 aa, Artificial Sequence
  Synthetic
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSGGSGGSTNLSDIIEKETGKQLVIQESILMLPEEVEEVIGNKPESDILVHTAYDESTDENVMLLTSDAPEYKPWALVIQDSNGENKIKMLSGGSGGSGGSTNLSDIIEKETGKQLVIQESILMLPEEVEEVIGNKPESDILVHTAYDESTDENVMLLTSDAPEYKPWALVIQDSNGENKIKMLSGGSPKKKRK

SEQ ID NO: 689 - protein, 1838 aa, Artificial Sequence
  Synthetic
MHHHHHHHHGSGGSGSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSGGSGGSTNLSDIIEKETGKQLVIQESILMLPEEVEEVIGNKPESDILVHTAYDESTDENVMLLTSDAPEYKPWALVIQDSNGENKIKMLSGGSGGSGGSTNLSDIIEKETGKQLVIQESILMLPEEVEEVIGNKPESDILVHTAYDESTDENVMLLTSDAPEYKPWALVIQDSNGENKIKMLSGGSPKKKRK

SEQ ID NO: 690 - protein, 1789 aa, Artificial Sequence
  Synthetic
MHHHHHHHHGSGGSGSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 691 - protein, 1775 aa, Artificial Sequence
  Synthetic
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 692 - RNA, 43 nt, Artificial Sequence
  Synthetic
guuuuagagcuagaaauagcaaguuaaaauaaggcuaguccgu

SEQ ID NO: 693 - protein, 1853 aa, Artificial Sequence; identical to SEQ ID NO: 12
  Synthetic

SEQ ID NO: 694 - protein, 1803 aa, Artificial Sequence
  Synthetic
MKRTADGSEFESPKKKRKVSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSKRTADGSEFEPKKKRKV

What is claimed is:

1. A nucleic acid molecule that comprises a nucleic acid sequence that is at least 85% identical to the sequence of any one of SEQ ID NOs: 45-48.

2. The nucleic acid molecule of claim 1, wherein the nucleic acid sequence comprises the sequence of any one of SEQ ID NOs: 45-48.

3. A vector comprising the nucleic acid of claim 1.

4. An isolated cell comprising the vector of claim 3.

5. A pharmaceutical composition comprising the vector of claim 3.

6. The nucleic acid molecule of claim 1, wherein the nucleic acid sequence comprises a sequence is at least 85%, at least 90%, at least 95%, or at least 98% identical to SEQ ID NO: 45.

7. The nucleic acid molecule of claim 1, wherein the nucleic acid sequence comprises the sequence of SEQ ID NO: 45.

8. The nucleic acid molecule of claim 1, wherein the nucleic acid sequence comprises a sequence is at least 85%, at least 90%, at least 95%, or at least 98% identical to SEQ ID NO: 46.

9. The nucleic acid molecule of claim 1, wherein the nucleic acid sequence comprises the sequence of SEQ ID NO: 46.

10. The nucleic acid molecule of claim 1, wherein the nucleic acid sequence comprises a sequence is at least 85%, at least 90%, at least 95%, or at least 98% identical to SEQ ID NO: 47.

11. The nucleic acid molecule of claim 1, wherein the nucleic acid sequence comprises the sequence of SEQ ID NO: 47.

12. The nucleic acid molecule of claim 1, wherein the nucleic acid sequence comprises a sequence is at least 85%, at least 90%, at least 95%, or at least 98% identical to SEQ ID NO: 48.

13. The nucleic acid molecule of claim 1, wherein the nucleic acid sequence comprises the sequence of SEQ ID NO: 48.

14. The nucleic acid molecule of claim 1, wherein the nucleic acid sequence is codon-optimized for expression in a mammalian cell.

15. An isolated cell comprising the nucleic acid molecule of claim 1.

16. A pharmaceutical composition comprising the nucleic acid molecule of claim 1.

17. A method of transfecting a cell, the method comprising transfecting the cell with the nucleic acid molecule of claim 1.

18. A method of transfecting a cell, the method comprising transfecting the cell with the vector of claim 3.

* * * * *